US012742163B2

(12) United States Patent
Baumgartner et al.

(10) Patent No.: US 12,742,163 B2
(45) Date of Patent: Sep. 22, 2026

(54) MODIFIED NUCLEASES

(71) Applicant: Celyntra Therapeutics SA, Mont-Saint-Guibert (BE)

(72) Inventors: Roland Baumgartner, Angern an der March (AT); Tanya Warnecke, Boulder, CO (US)

(73) Assignee: Artisan Developments Labs, INC, Boulder, CO (US)

( * ) Notice: Subject to any disclaimer, the term of this patent is extended or adjusted under 35 U.S.C. 154(b) by 0 days.

(21) Appl. No.: 18/289,723

(22) PCT Filed: May 6, 2022

(86) PCT No.: PCT/US2022/028208
§ 371 (c)(1),
(2) Date: Nov. 6, 2023

(87) PCT Pub. No.: WO2022/236147
PCT Pub. Date: Nov. 10, 2022

(65) Prior Publication Data

US 2026/0009009 A1 Jan. 8, 2026

Related U.S. Application Data

(60) Provisional application No. 63/315,483, filed on Mar. 1, 2022, provisional application No. 63/185,315, filed on May 6, 2021.

(51) Int. Cl.
*C12N 9/22* (2006.01)
*C12N 15/10* (2006.01)
*C12N 15/11* (2006.01)

(52) U.S. Cl.
CPC ............... *C12N 9/22* (2013.01); *C12N 9/226* (2025.05); *C12N 15/102* (2013.01); *C12N 15/11* (2013.01); *C07K 2319/09* (2013.01); *C07K 2319/21* (2013.01); *C12N 2310/20* (2017.05)

(58) Field of Classification Search
None
See application file for complete search history.

(56) References Cited

U.S. PATENT DOCUMENTS

| | | | | |
|---|---|---|---|---|
| 11,649,442 | B2 | 5/2023 | Halperin | |
| 2018/0371497 | A1* | 12/2018 | Gill | C12N 15/11 |
| 2020/0299661 | A1 | 9/2020 | Gori et al. | |
| 2020/0354703 | A1 | 11/2020 | Mijts et al. | |
| 2022/0136014 | A1* | 5/2022 | Gill | C12N 15/907 435/461 |

FOREIGN PATENT DOCUMENTS

| | | | | |
|---|---|---|---|---|
| JP | 2020/530264 | A | 10/2020 | |
| WO | 2017/106569 | A1 | 6/2017 | |
| WO | 2020/011985 | A1 | 1/2020 | |
| WO | 2020/092057 | A1 | 5/2020 | |
| WO | 2020/092608 | A1 | 5/2020 | |
| WO | 2020/109412 | A1 | 6/2020 | |
| WO | 2021/050601 | A1 | 3/2021 | |
| WO | 2021/074191 | A1 | 4/2021 | |
| WO | WO-2021067788 | A1 * | 4/2021 | C12N 15/907 |

OTHER PUBLICATIONS

Pollard et al., A Novel Receptor-Mediated Nuclear Protein Import Pathway, Cell 86, 1996, 985-94. (Year: 1996).*
Staahl et al., Efficient genome editing in the mouse brain by local delivery of engineered Cas9 ribonucleoprotein complexes, Nature Biotechnol. 35, 2017, 431-34. (Year: 2017).*
Dubois et al., Safe Harbor Targeted CRISPR-Cas9 Tools for Molecular-Genetic Imaging of Cells in Living Subjects, CRISPR J. 1, 2018, 440-49. (Year: 2018).*
Wierson et al. Expanding the CRISPR toolbox with ErCas12a in Zebrafish and Human Cells. The CRISPR Journal 2019;2(6):417-433.
Rojek et al. Mad7: An IP friendly CRISPR enzyme. Authorea. Aug. 10, 2021.
Database UniProt Ratnikova N.M. et al. "Type V CRISPR-associated protein Cpf1 from Sulfurimonas crateris" XP002808334 retrieved from EBI accession No. UNIPROT:AOA4U2Z946 [online] Jul. 31, 2019.
Liu et al., "ErCas12a CRISPR-MAD7 for Model Generation in Human Cells, Mice, and Rats", The CRISPR Journal 2020;3:97-108.
Fernandez et al., "Optimized CRISPR-Cpf1 system for genome editing in zebrafish", Methods 2018; 150:11-18.
Li et al., "Base editing with a Cpf1—cytidine deaminase fusion", Nature Biotechnology 2018 ;36:324-327 + online methods.
Li et al. Supplemental Information, Nature Biotechnology ;2018;36:324-327.
Del'Guidice et al., "Membrane permeabilizing amphiphilic peptide delivers recombinant transcription factor and CRISPR-Cas9/Cpf1 ribonucleoproteins in hard-to-modify cells", Plos One 2018 ; 13:e0195558.
Zhang et al., "CRISPR-Cpf1 correction of muscular dystrophy mutations in human cardiomyocytes and mice", Science Advances 2017;3:e1602814.
Peters et al., "Genome editing in human pluripotent stem cells". In: StemBook. Harvard Stem Cell Institute, Cambridge (MA);2008. PMID:23785737.
Tsang et al., "Generation and characterization of pathogenic Mab21l2(R51C) mouse model", Genesis 2018;56(11-12):e23261.
Gier et al. "High-performance CRISPR-Cas12a genome editing for combinatorial genetic screening", Nature Communications 2020 ; 11 :3455.

(Continued)

*Primary Examiner* — Todd M Epstein
(74) *Attorney, Agent, or Firm* — Ipsilon USA—NLO

(57) ABSTRACT

Provided herein are methods and compositions utilizing modified nucleases and/or other components, such as guide nucleic acids and donor templates, for use in a CRISPR system.

13 Claims, 21 Drawing Sheets

Specification includes a Sequence Listing.

(56) References Cited

OTHER PUBLICATIONS

Gier et al. Supplemental Information for: High-performance CRISPR-Casi2a genome editing for combinatorial genetic screening. Nature Communications 2020 ;11 :3455.
Kleinstiver et al., "Engineered CRISPR-Cas12a variants with increased activities and improved targeting ranges for gene, epigenetic and base editing" Nature Biotechnology 2019;37:276-282.
Kleinstiver et al., "Supplementary Figure 6: Properties of base editors derived from enAsCaslZa and CastZa orthologs". Nature Biotechnology 2019;37:276-282.

* cited by examiner

MODIFIED NUCLEASES

CROSS-REFERENCE

This application is a continuation of PCT/US2022/028208, filed May 6, 2022, which claims priority to U.S. Provisional Application No. 63/185,315, filed May 6, 2021, and to U.S. Provisional Application No. 63/315,483, filed Mar. 1, 2022, both of which are incorporated herein by reference.

SEQUENCE LISTING

The instant application contains a Sequence Listing which has been submitted electronically in .TXT file format and is hereby incorporated by reference in its entirety. Said. TXT copy, created on Jun. 16, 2023, is named P62036790WO-US_ST25.txt and is 1.550.589 bytes in size.

BACKGROUND

Nucleic acid-guided nucleases have become important tools for research and genome engineering. The applicability of these tools can be limited by the sequence specificity requirements, expression, or delivery issues.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 1 discloses "His6" as SEQ ID NO: 423.

FIG. 15 discloses SEQ ID NOS 424-427, 427-429 and 429-454, respectively, in order of appearance.

FIG. 16 discloses SEQ ID NOS 455-484, 453-454 and 485-487, respectively, in order of appearance.

DETAILED DESCRIPTION

Figure 1:
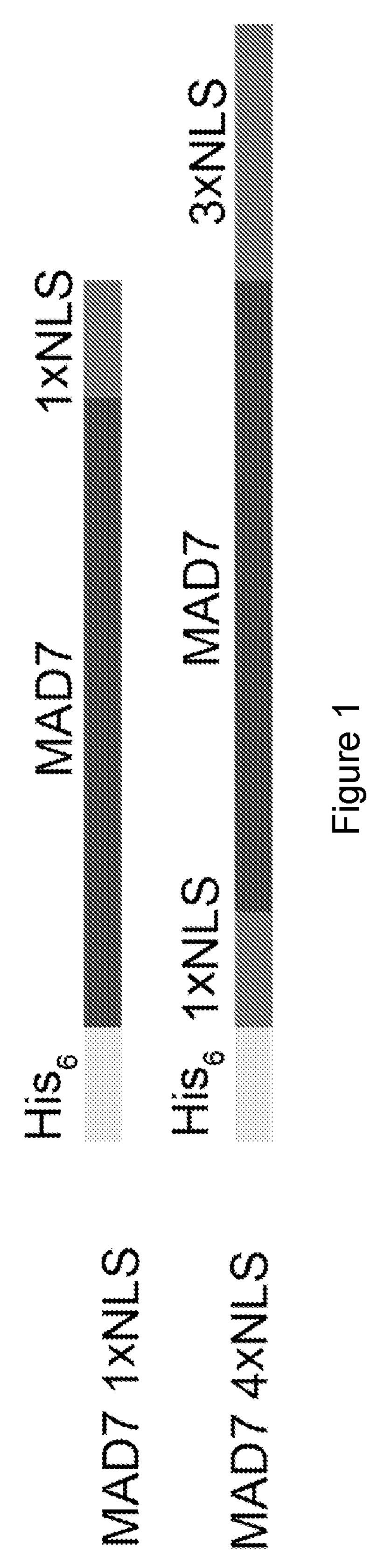
FIG. 1 shows a diagram of MAD7 comprising one or more nuclear localization signals (NLS).

CRISPR is an abbreviation of Clustered Regularly Interspaced Short Palindromic Repeats. In a palindromic repeat, the sequence of nucleotides is the same in both directions. Each of these palindromic repetitions is followed by short segments of spacer DNA. Small clusters of Cas (CRISPR-associated system) genes are located next to CRISPR sequences. The CRISPR/Cas system is a prokaryotic immune system that can confer resistance to foreign genetic elements such as those present within plasmids and phages providing the prokaryote a form of acquired immunity. RNA harboring a spacer sequence assists Cas (CRISPR-associated) proteins to recognize and cut exogenous DNA. CRISPR sequences are found in approximately 50% of bacterial genomes and nearly 90% of sequenced archaea has selected for efficient and robust metabolic and regulatory networks that prevent unnecessary metabolite biosynthesis and optimally distribute resources to maximize overall cellular fitness. The complexity of these networks with limited approaches to understand their structure and function and the ability to re-program cellular networks to modify these systems for a diverse range of applications has complicated advances in this space. Certain approaches to re-program cellular networks are directed to modifying single genes of complex pathways but as a consequence of modifying single genes, unwanted modifications to the genes or other genes can result, getting in the way of identifying changes necessary to achieve a sought-after endpoint as well as complicating the endpoint sought by the modification.

CRISPR-Cas driven genome editing and engineering has dramatically impacted biology and biotechnology in general. CRISPR-Cas editing systems require a polynucleotide guided nuclease, a guide nucleic acid (gNA) e.g. a guide RNA (gRNA)) that directs the nuclease to cut a specific region of the genome, and, optionally, a donor DNA cassette (also referred to herein as a donor template or editing sequence) that can be used to repair the cut dsDNA and thereby incorporate programmable edits at the site of interest. The earliest demonstrations and applications of CRISPR-Cas editing used Cas9 nucleases and associated gRNA. These systems have been used for gene editing in a broad range of species encompassing bacteria to higher order mammalian systems such as animals and in certain cases, humans. It is well established, however, that important editing parameters such as protospacer adjacent motif (PAM) specificity, editing efficiency, and off-target rates, among others, are species, loci, and nuclease dependent. There is increasing interest in identifying and rapidly characterizing novel nuclease systems that can be exploited to broaden and improve overall editing capabilities.

One version of the CRISPR/Cas system, CRISPR/Cas9, has been modified to provide useful tools for editing targeted genomes. By delivering the Cas9 nuclease complexed with a synthetic guide RNA (gRNA) into a cell, the cell's genome can be cut/edited at a predetermined location, allowing existing genes to be removed and/or new ones added. These systems are useful but have some important limitations regarding efficiency and accuracy of targeted editing, imprecise editing complications, as well as impediments when used for commercially relevant situations such as gene replacement. Therefore, a need exists for improved nucleic acid guided nuclease systems for directed and accurate editing with improved efficiency.

As used herein, the term "modulating" and "manipulating" of genome editing can mean an increase, a decrease, upregulation, downregulation, induction, a change in editing activity, a change in binding, a change cleavage or the like, of one or more of targeted genes or gene clusters of certain embodiments disclosed herein.

In certain embodiments of the present disclosure, there can be employed conventional molecular biology, microbiology, and recombinant DNA techniques within the skill of the art. Such techniques are explained fully in the literature and understood by those of skill in the art.

In other embodiments, primers used herein for preparation per conventional techniques can include sequencing primers and amplification primers. In some embodiments, plasmids and oligomers used in conventional techniques can include synthesized oligomers and oligomer cassettes.

In some embodiments disclosed herein, nucleic acid-guided nuclease systems and methods of use are provided. A nuclease system can include transcripts and other elements involved in the expression of an engineered nuclease disclosed herein, which can include sequences encoding a novel engineered nucleic acid-guided nuclease protein and a guide sequence (gRNA) or a novel gRNA as disclosed herein. In some embodiments, nucleic acid-guided nuclease systems can include at least one CRISPR-associated nucleic acid guided nuclease construct, the disclosure of which are provided herein. In other embodiments, nucleic acid-guided nuclease systems can include at least one known guide sequence (gRNA) or at least one novel gRNA, such as a single gRNA or a dual gRNA. In some embodiments, an engineered nucleic acid-guided nuclease of the instant invention can be used in systems for editing a gene of interest in humans or other species.

Bacterial and archaeal targetable nuclease systems have emerged as powerful tools for precision genome editing. However, naturally occurring nucleases have some limitations including expression and delivery challenges due to the nucleic acid sequence and protein size. In certain embodiments, novel engineered nucleic acid-guided nuclease constructs disclosed herein can be created for targeting of a targeted gene and/or increased efficiency and/or accuracy of targeted gene editing in a subject.

In accordance with these embodiments, it is known that Cas12a is a single RNA-guided CRISPR/Cas endonuclease capable of genome editing having differing features when compared to Cas9. In certain embodiments, a Cas12a-based system allow fast and reliable introduction of donor DNA into a genome. In addition, Cas12a broadens genome editing. CRISPR/Cas12a genome editing has been evaluated in human cells as well as other organisms including plants. Several features of the CRISPR/Cas12a system are different when compared to CRISPR/Cas9.

It is known that Cas12a nuclease recognizes T-rich protospacer adjacent motif (PAM) sequences (e.g. 5'-TTTN-3' (AsCas12a, LbCas12a) and 5'-TTN-3' (FnCas12a); whereas, the comparable sequence for SpCas9 is NGG. The PAM sequence of Cas12a is located at the 5' end of the target DNA sequence, where it is at the 3' end for Cas9. In addition, Cas12a is capable of cleaving DNA distal to its PAM around the +18/+23 position of the protospacer. This cleavage creates a staggered DNA overhang (e.g. sticky ends), whereas Cas9 cleaves close to its PAM after the 3' position of the protospacer at both strands and creates blunt ends. In certain methods, creating altered recognition of nucleases can provide an improvement over Cas9 or Cas12a to improve accuracy. Further, Cas12a is guided by a single crRNA and does not require a tracrRNA, resulting in a shorter gRNA sequence than the sgRNA used by Cas9. Surprisingly, it has been found that the modified Cas12a nucleases provided herein can also function with a dual gRNA.

It is also known that Cas12a displays additional ribonuclease activity that functions in crRNA processing. Cas12a is used as an editing tool for different species (e.g. *S. cerevisiae*), allowing the use of an alternative PAM sequence compared with the one recognized by CRISPR/Cas9. Novel nucleases disclosed herein can further recognize the same or alternative PAM sequences. These novel nucleases can provide an alternative system for multiplex genome editing as compared with known multiplex approaches and can be used as an improved system in mammalian gene editing.

Well-known Cas12a protein-RNA complexes recognize a T-rich PAM and cleavage leads to a staggered DNA double-stranded break. Cas12a-type nuclease interacts with the pseudoknot structure formed by the 5'-handle of crRNA. A guide RNA segment, composed of a seed region and the 3' terminus, possesses complementary binding sequences with the target DNA sequences. Cas12a type nucleases characterized to date have been demonstrated to work with a single gRNA and to process gRNA arrays. While Cas12a-type and Cas9 nuclease systems have proven highly impactful, neither system has been demonstrated to function as predictably as is desired to enable the full range of applications envisioned for gene-editing technologies.

In the current state, a range of efforts have attempted to engineer improved CRISPR editing systems having increased efficiency and accuracy, which have included engineering of the PAM specificity, stability, and sequence of the gRNA and-or the nuclease. For example, chemical modifications of CRISPR/Cas9 gRNA expected to increase gRNA stability was found to lead to a 3.8-fold higher indel frequencies in human cells. In addition, other studies included structure-guided mutagenesis of Cas12a and screened to identify variants with an increased range of recognized PAM sequences. These engineered AsCas12a recognized TYCV and TATV PAMs in addition to the established TTTV sequence, with enhanced activities in vitro and in tested human cells.

In certain embodiments, Cas12a-like nucleases and engineered gRNAs disclosed herein are contemplated for use in bacteria, and other prokaryotes. In certain embodiments, engineered designer nucleases are contemplated for use in eukaryotes such as yeast, mammals, e.g., human as well as of use in birds and fish, or cells derived from same.

In some embodiments, off-targeting rates for nuclease constructs disclosed herein can be reduced compared to a control, e.g., a native sequence, for improved editing. Off-targeting rates can be readily tested.

In some embodiments, nuclease constructs disclosed herein can share conserved encoded motifs of known nucleases. In other embodiments, nuclease constructs disclosed herein do not share conserved encoded peptide motifs with known nucleases. In preferred embodiments, provided herein are compositions, methods, and/or kits wherein the CRISPR nuclease comprises a Type V nuclease. In certain embodiments, provided herein are compositions, methods, and/or kits wherein the CRISPR nuclease comprises a Type V-A, V-B, V-C, V-D, or V-E CRISPR nuclease. In certain embodiments, provided herein are compositions, methods, and/or kits wherein the CRISPR nuclease comprises a Type V-A nuclease. Naturally occurring type V-A CRISPR nucleases comprise a RuvC-like nuclease domain but lack an HNH endonuclease domain, and recognize a 5' T-rich PAM located immediately upstream from the target nucleotide sequence, the orientation determined using the non-target strand (i.e., the strand not hybridized with the spacer sequence) as the coordinate. These CRISPR nucleases cleave a double-stranded DNA to generate a staggered double-stranded break rather than a blunt end. The cleavage site is distant from the PAM site (e.g., separated by at least 10, 11, 12, 13, 14, or 15 nucleotides downstream from the PAM on the non-target strand and/or separated by at least 15, 16, 17, 18, or 19 nucleotides upstream from the sequence complementary to PAM on the target strand).

In certain embodiments, a type V-A CRISPR nuclease comprises Cpf1. Cpf1 proteins are known in the art and are described, e.g., in U.S. Pat. Nos. 9,790,490 and 10,113,179. Cpf1 orthologs can be found in various bacterial and archaeal genomes. For example, in certain embodiments, the Cpf1 protein is derived from *Francisella novicida* U112 (Fn), *Acidaminococcus* sp. BV3L6 (As), *Lachnospiraceae bacterium* ND2006 (Lb), *Lachnospiraceae bacterium* MA2020 (Lb2), *Candidatus methanoplasma termitum* (CMt), *Moraxella bovoculi* 237 (Mb), *Porphyromonas crevioricanis* (Pc), *Prevotella disiens* (Pd), *Francisella tularensis* 1, *Francisella tularensis* subsp. *novicida, Prevotella albensis, Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Eubacterium eligens, Leptospira inadai, Porphyromonas macacae, Prevotella bryantii, Proteocatella sphenisci, Anaerovibrio* sp. RM50, *Moraxella caprae, Lachnospiraceae bacterium* COE1, or *Eubacterium coprostanoligenes*.

In certain embodiments, a type V-A CRISPR nuclease comprises AsCpf1 or a variant thereof. In certain embodiments, a type V-A CRISPR nucleases comprises an amino acid sequence at least 30%, 40%, 50%, 60%, 70%, 80%, 85%, 90%, 91%, 92%, 93%, 94%, 95%, 96%, 97%, 98%, 99%, or 100% identical to the amino acid sequence set forth in SEQ ID NO: 3 of International (PCT) Application Publication No. WO 2021/158918. In certain embodiments, a type V-A CRISPR nucleases comprises the amino acid sequence set forth in SEQ ID NO: 3 of International (PCT) Application Publication No. WO 2021/158918.

In certain embodiments, a type V-A CRISPR nuclease comprises LbCpf1 or a variant thereof. In certain embodiments, a type V-A CRISPR nucleases comprises an amino acid sequence at least 30%, 40%, 50%, 60%, 70%, 80%, 85%, 90%, 91%, 92%, 93%, 94%, 95%, 96%, 97%, 98%, 99%, or 100% identical to the amino acid sequence set forth in SEQ ID NO: 4 of International (PCT) Application Publication No. WO 2021158918. In certain embodiments, a type V-A Cas protein comprises the amino acid sequence set forth in SEQ ID NO: 4 of International (PCT) Application Publication No. WO 2021/158918.

In certain embodiments, a type V-A CRISPR nuclease comprises FnCpf1 or a variant thereof. In certain embodiments, a type V-A Cas protein comprises an amino acid sequence at least 30%, 40%, 50%, 60%, 70%, 80%, 85%, 90%, 91%, 92%, 93%, 94%, 95%, 96%, 97%, 98%, 99%, or 100% identical to the amino acid sequence set forth in SEQ ID NO: 5 of International (PCT) Application Publication No. WO 2021158918. In certain embodiments, a type V-A Cas protein comprises the amino acid sequence set forth in SEQ ID NO: 5 of International (PCT) Application Publication No. WO 2021/158918.

In certain embodiments, a type V-A CRISPR nuclease comprises *Prevotella bryantii* Cpf1 (PbCpf1) or a variant thereof. In certain embodiments, a type V-A Cas protein comprises an amino acid sequence at least 30%, 40%, 50%, 60%, 70%, 80%, 85%, 90%, 91%, 92%, 93%, 94%, 95%, 96%, 97%, 98%, 99%, or 100% identical to the amino acid sequence set forth in SEQ ID NO: 6 of International (PCT) Application Publication No. WO 2021/158918. In certain embodiments, a type V-A Cas protein comprises the amino acid sequence set forth in SEQ ID NO: 6 of International (PCT) Application Publication No. WO 2021/158918.

In certain embodiments, a type V-A CRISPR nuclease comprises *Proteocatella sphenisci* Cpf1 (PsCpf1) or a variant thereof. In certain embodiments, a type V-A Cas protein comprises an amino acid sequence at least 30%, 40%, 50%, 60%, 70%, 80%, 85%, 90%, 91%, 92%, 93%, 94%, 95%, 96%, 97%, 98%, 99%, or 100% identical to the amino acid sequence set forth in SEQ ID NO: 7 of International (PCT)

Application Publication No. WO 2021158918. In certain embodiments, a type V-A Cas protein comprises the amino acid sequence set forth in SEQ ID NO: 7 of International (PCT) Application Publication No. WO 2021/158918.

In certain embodiments, a type V-A CRISPR nuclease comprises *Anaerovibrio* sp. RM50 Cpf1 (As2Cpf1) or a variant thereof. In certain embodiments, a type V-A Cas protein comprises an amino acid sequence at least 30%, 40%, 50%, 60%, 70%, 80%, 85%, 90%, 91%, 92%, 93%, 94%, 95%, 96%, 97%, 98%, 99%, or 100% identical to the amino acid sequence set forth in SEQ ID NO: 8 of International (PCT) Application Publication No. WO 2021158918. In certain embodiments, a type V-A Cas protein comprises the amino acid sequence set forth in SEQ ID NO: 8 of International (PCT) Application Publication No. WO 2021/158918.

In certain embodiments, a type V-A CRISPR nuclease comprises *Moraxella caprae* Cpf1 (McCpf1) or a variant thereof. In certain embodiments, a type V-A Cas protein comprises an amino acid sequence at least 30%, 40%, 50%, 60%, 70%, 80%, 85%, 90%, 91%, 92%, 93%, 94%, 95%, 96%, 97%, 98%, 99%, or 100% identical to the amino acid sequence set forth in SEQ ID NO: 9 of International (PCT) Application Publication No. WO 2021/158918. In certain embodiments, a type V-A Cas protein comprises the amino acid sequence set forth in SEQ ID NO: 9 of International (PCT) Application Publication No. WO 2021/158918.

In certain embodiments, a type V-A CRISPR nuclease comprises *Lachnospiraceae bacterium* COE1 Cpf1 (Lb3Cpf1) or a variant thereof. In certain embodiments, a type V-A Cas protein comprises an amino acid sequence at least 30%, 40%, 50%, 60%, 70%, 80%, 85%, 90%, 91%, 92%, 93%, 94%, 95%, 96%, 97%, 98%, 99%, or 100% identical to the amino acid sequence set forth in SEQ ID NO: 10 of International (PCT) Application Publication No. WO 2021158918. In certain embodiments, a type V-A Cas protein comprises the amino acid sequence set forth in SEQ ID NO: 10 of International (PCT) Application Publication No. WO 2021/158918.

In certain embodiments, a type V-A CRISPR nuclease comprises *Eubacterium coprostanoligenes* Cpf1 (EcCpf1) or a variant thereof. In certain embodiments, a type V-A Cas protein comprises an amino acid sequence at least 30%, 40%, 50%, 60%, 70%, 80%, 85%, 90%, 91%, 92%, 93%, 94%, 95%, 96%, 97%, 98%, 99%, or 100% identical to the amino acid sequence set forth in SEQ ID NO: 11 of International (PCT) Application Publication No. WO 2021158918. In certain embodiments, a type V-A Cas protein comprises the amino acid sequence set forth in SEQ ID NO: 11 of International (PCT) Application Publication No. WO 2021/158918.

In certain embodiments, a type V-A CRISPR nuclease is not Cpf1. In certain embodiments, a type V-A CRISPR nuclease is not AsCpf1.

In certain embodiments, a type V-A CRISPR nuclease comprises a Type V-A nuclease described in U.S. Pat. No. 9,982,279.

In certain embodiments, a Type VA CRISPR nuclease polypeptide used in compositions and methods herein can be represented by a polypeptide that includes a sequence that has at least 60, 70, 80, 85, 90, 95, 96, 97, 98, 99, or 100% sequence identity, preferably at least 80%, more preferably at least 90%, even more preferably at least 95%, still more preferably at least 98% sequence identity with SEQ ID NO: 1 SEQ ID NO: 1 wherein the Type VA CRISPR nuclease polypeptide further comprises at least one, two, three, four, five or six nuclear localization sequences (NLS), each of which can be at or near the amino end or carboxy end of the CRISPR nuclease polypeptide; and/or one or more purification tags; in addition, a cleavage sequence can be provided to remove portions of a protopeptide. As used herein, the term "at or near" an N-terminus or a C-terminus includes where the nearest amino acid of the NLS to the N- or C-terminus is within 300 amino acids, in some cases within 200 amino acids, from the N- or C-terminus of the polypeptide (e.g., a core polypeptide such as one of the CRISPR nucleases described herein, to which the NLS or NLSs is attached). In certain embodiments, a Type V CRISPR nuclease polypeptide, e.g., Type Va CRISPR polypeptide, comprises two, three, four, or five NLSs, each of which are at or near the N-terminus or the C-terminus of the polypeptide, in preferred embodiments the NLSs are at or near the N-terminus. In certain embodiments, a CRISPR nuclease polypeptide, including one or more NLSs and, in some cases, a purification tag and/or a cleavage site, comprises a sequence at least 60, 70, 80, 85, 90, 95, 98, 99%, or 100%, identical, preferably at least 80%, more preferably at least 90%, even more preferably at least 95%, still more preferably at least 98% identical to any one of SEQ ID NOs: 109-112. In certain embodiments, a Type V, e.g., VA CRISPR nuclease polypeptide comprises at least 1-30, 1-20, 1-15, 1-10, 1-9, 1-8, 1-7, 1-6, 1-5, 2-30, 2-20, 2-15, 2-10, 2-9, 2-8, 2-7, 2-6, 2-5, 3-30, 3-20, 3-15, 3-10, 3-9, 3-8, 3-7, 3-6, or 3-5, preferably 1-10, more preferably 2-10, even more preferably 3-10 NLSs, each of which is at or near the N-terminus or the C-terminus of the polypeptide, in preferred embodiments at or near the N-terminus. In certain embodiments, at least two, or at least three, of the NLSs have different mechanisms, that is, different mechanisms by which they localize an attached polypeptide to a nucleus. Such mechanisms are well-known in the art; see, e.g., Lu et al. Cell Commun Signal (2021) 19:60 https://doi.org/10.1186/s12964-021-00741-y. Suitable NLS, purification tag, and cleavage site sequences can be as described elsewhere herein, e.g., in sections labeled Nuclear Localization Signals, Purification Tags, and Cleavage Sites.

SEQ ID NO: 1

```
MNNGTNNFQNFIGISSLQKTLRNALIPTETTQQFIVKNGIIKEDE

LRGENRQILKDIMDDYYRGFISETLSSIDDIDWTSLFEKMEIQLK

NGDNKDTLIKEQTEYRKAIHKKFANDDRFKNMFSAKLISDILPEF

VIHNNNYSASEKEEKTQVIKLFSRFATSFKDYFKNRANCFSADDI

SSSSCHRIVNDNAEIFFSNALVYRRIVKSLSNDDINKISGDMKDS

LKEMSLEEIYSYEKYGEFITQEGISFYNDICGKVNSFMNLYCQKN

KENKNLYKLQKLHKQILCIADTSYEVPYKFESDEEVYQSVNGFLD

NISSKHIVERLRKIGDNYNGYNLDKIYIVSKFYESVSQKTYRDWE

TINTALEIHYNNILPGNGKSKADKVKKAVKNDLQKSITEINELVS

NYKLCSDDNIKAETYIHEISHILNNFEAQELKYNPEIHLVESELK

ASELKNVLDVIMNAFHWCSVFMTEELVDKDNNFYAELEEIYDEIY

PVISLYNLVRNYVTQKPYSTKKIKLNFGIPTLADGWSKSKEYSNN

AIILMRDNLYYLGIFNAKNKPDKKIIEGNTSENKGDYKKMIYNLL

PGPNKMIPKVFLSSKTGVETYKPSAYILEGYKQNKHIKSSKDFDI

TFCHDLIDYFKNCIAIHPEWKNFGFDFSDTSTYEDISGFYREVEL

QGYKIDWTYISEKDIDLLQEKGQLYLFQIYNKDFSKKSTGNDNLH
```

-continued

TMYLKNLFSEENLKDIVLKLNGEAEIFFRKSSIKNPIIHKKGSIL

VNRTYEAEEKDQFGNIQIVRKNIPENIYQELYKYFNDKSDKELSD

EAAKLKNVVGHHEAATNIVKDYRYTYDKYFLHMPITINFKANKTG

FINDRILQYIAKEKDLHVIGIDRGERNLIYVSVIDTCGNIVEQKS

FNIVNGYDYQIKLKQQEGARQIARKEWKEIGKIKEIKEGYLSLVI

HEISKMVIKYNAIIAMEDLSYGFKKGRFKVERQVYQKFETMLINK

LNYLVFKDISITENGGLLKGYQLTYIPDKLKNVGHQCGCIFYVPA

AYTSKIDPTTGFVNIFKFKDLTVDAKREFIKKFDSIRYDSEKNLF

CFTFDYNNFITQNTVMSKSSWSVYTYGVRIKRRFVNGRFSNESDT

IDITKDMEKTLEMTDINWRDGHDLRQDIIDYEIVQHIFEIFRLTV

QMRNSLSELEDRDYDRLISPVLNENNIFYDSAKAGDALPKDADAN

GAYCIALKGLYEIKQITENWKEDGKFSRDKLKISNKDWFDFIQNK

RYL

Nucleotide sequences coding for SEQ ID NO: 1 can include sequences with less than 99, 95, 90, 85, 80, 75, 70, 65, 60, 55, 50, 45, or 40% sequence identity with SEQ ID NO: 22, in preferred embodiments less than 75% sequence identity. In certain embodiments, a nucleotide sequence coding for SEQ ID NO: 1 can also include nucleic acid sequences coding for one or more NLS at the N-terminus and/or C-terminus, as described herein, and/or a tag such as a purification tag at the N-terminus, as described herein. In certain embodiments, provided herein are compositions comprising a first polynucleotide coding for a polypeptide comprising a nucleic acid-guided nuclease comprising a CRISPR Type V nuclease polypeptide, wherein the polynucleotide has less than 75% sequence identity to SEQ ID NO: 22, such as wherein the nuclease polypeptide comprises at least 1, 2, 3, 4, or 5 NLSs, wherein each of the NLSs is at or near the N-terminus or the C-terminus of the nuclease polypeptide. NLSs can be any of those described herein. The first polynucleotide can comprise a sequence coding for a purification tag, such as a purification tag described herein, and/or cleavage site, such as a cleavage site described herein. In certain embodiments the first polynucleotide codes for a polypeptide comprising a sequence at least 60, 70, 80, 85, 90, 95, 98, 99%, or 100%, identical, preferably at least 80%, more preferably at least 90%, even more preferably at least 95%, still more preferably at least 98% identical to any one of SEQ ID NOs: 109-112, such as SEQ ID NO: 109, or SEQ ID NO: 110, or SEQ ID NO: 111, or SEQ ID NO: 112. the first polynucleotide comprises a sequence at least 50, 60, 70, 80, 90, 95, 97, or 99% identical, or 100% identical, preferably at least 80%, more preferably at least 90%, even more preferably at least 95%, still more preferably at least 98% identical to SEQ ID NO: 113. In certain embodiment the composition further comprises a second polynucleotide coding for a gNA or portion thereof, wherein the gNA, e.g., gRNA, comprises a spacer sequence that targets a target nucleotide sequence within a polynucleotide, or a polynucleotide coding for the gNA, e.g., gRNA, wherein the gNA, e.g., gRNA is compatible with the Type V CRISPR nuclease. In certain embodiments the first and second polynucleotides are the same. The composition can further comprise a third polynucleotide comprising a donor template. In certain embodiments, provided is a vector comprising one of the polynucleotide compositions of this paragraph. In certain embodiments, provided is a cell comprising one of the polynucleotide compositions of this paragraph, e.g., a human cell, such as an immune cell, for example a T cell, or a stem cell, such as an iPSC. In certain embodiments, provided is a method comprising inserting any one of the polynucleotide compositions of this paragraph into a cell. In certain embodiments inserting the composition comprises electroporation.

SEQ ID NO: 22:
ATGAACAACGGCACAAATAATTTTCAGAACTTCATCGGGATCTCA

AGTTTGCAGAAAACGCTGCGCAATGCTCTGATCCCCACGGAAACC

ACGCAACAGTTCATCGTCAAGAACGGAATAATTAAAGAAGATGAG

TTACGTGGCGAGAACCGCCAGATTCTGAAAGATATCATGGATGAC

TACTACCGCGGATTCATCTCTGAGACTCTGAGTTCTATTGATGAC

ATAGATTGGACTAGCCTGTTCGAAAAAATGGAAATTCAGCTGAAA

AATGGTGATAATAAAGATACCTTAATTAAGGAACAGACAGAGTAT

CGGAAAGCAATCCATAAAAAATTTGCGAACGACGATCGGTTTAAG

AACATGTTTAGCGCCAAACTGATTAGTGACATATTACCTGAATTT

GTCATCCACAACAATAATTATTCGGCATCAGAGAAAGAGGAAAAA

ACCCAGGTGATAAAATTGTTTTCGCGCTTTGCGACTAGCTTTAAA

GATTACTTCAAGAACCGTGCAAATTGCTTTTCAGCGGACGATATT

TCATCAAGCAGCTGCCATCGCATCGTCAACGACAATGCAGAGATA

TTCTTTTCAAATGCGCTGGTCTACCGCCGGATCGTAAAATCGCTG

AGCAATGACGATATCAACAAAATTTCGGGCGATATGAAAGATTCA

TTAAAAGAAATGAGTCTGGAAGAAATATATTCTTACGAGAAGTAT

GGGGAATTTATTACCCAGGAAGGCATTAGCTTCTATAATGATATC

TGTGGGAAAGTGAATTCTTTTATGAACCTGTATTGTCAGAAAAAT

AAAGAAAACAAAAATTTATACAAACTTCAGAAACTTCACAAACAG

ATTCTATGCATTGCGGACACTAGCTATGAGGTCCCGTATAAATTT

GAAAGTGACGAGGAAGTGTACCAATCAGTTAACGGCTTCCTTGAT

AACATTAGCAGCAAACATATAGTCGAAAGATTACGCAAAATCGGC

GATAACTATAACGGCTACAACCTGGATAAAATTTATATCGTGTCC

AAATTTTACGAGAGCGTTAGCCAAAAAACCTACCGCGACTGGGAA

ACAATTAATACCGCCCTCGAAATTCATTACAATAATATCTTGCCG

GGTAACGGTAAAAGTAAAGCCGACAAAGTAAAAAAAGCGGTTAAG

AATGATTTACAGAAATCCATCACCGAAATAAATGAACTAGTGTCA

AACTATAAGCTGTGCAGTGACGACAACATCAAAGCGGAGACTTAT

ATACATGAGATTAGCCATATCTTGAATAACTTTGAAGCACAGGAA

TTGAAATACAATCCGGAAATTCACCTAGTTGAATCCGAGCTCAAA

GCGAGTGAGCTTAAAAACGTGCTGGACGTGATCATGAATGCGTTT

CATTGGTGTTCGGTTTTTATGACTGAGGAACTTGTTGATAAAGAC

AACAATTTTTATGCGGAACTGGAGGAGATTTACGATGAAATTTAT

CCAGTAATTAGTCTGTACAACCTGGTTCGTAACTACGTTACCCAG

AAACCGTACAGCACGAAAAAGATTAAATTGAACTTTGGAATACCG

-continued

ACGTTAGCAGACGGTTGGTCAAAGTCCAAAGAGTATTCTAATAAC
GCTATCATACTGATGCGCGACAATCTGTATTATCTGGGCATCTTT
AATGCGAAGAATAAACCGGACAAGAAGATTATCGAGGGTAATACG
TCAGAAAATAAGGGTGACTACAAAAAGATGATTTATAATTTGCTC
CCGGGTCCCAACAAAATGATCCCGAAAGTTTTCTTGAGCAGCAAG
ACGGGGGTGGAAACGTATAAACCGAGCGCCTATATCCTAGAGGGG
TATAAACAGAATAAACATATCAAGTCTTCAAAAGACTTTGATATC
ACTTTCTGTCATGATCTGATCGACTACTTCAAAAACTGTATTGCA
ATTCATCCCGAGTGGAAAAACTTCGGTTTTGATTTTAGCGACACC
AGTACTTATGAAGACATTTCCGGGTTTTATCGTGAGGTAGAGTTA
CAAGGTTACAAGATTGATTGGACATACATTAGCGAAAAAGACATT
GATCTGCTGCAGGAAAAAGGTCAACTGTATCTGTTCCAGATATAT
AACAAAGATTTTTCGAAAAAATCAACCGGGAATGACAACCTTCAC
ACCATGTACCTGAAAAATCTTTTCTCAGAAGAAAATCTTAAGGAT
ATCGTCCTGAAACTTAACGGCGAAGCGGAAATCTTCTTCAGGAAG
AGCAGCATAAAGAACCCAATCATTCATAAAAAAGGCTCGATTTTA
GTCAACCGTACCTACGAAGCAGAAGAAAAAGACCAGTTTGGCAAC
ATTCAAATTGTGCGTAAAAATATTCCGGAAAACATTTATCAGGAG
CTGTACAAATACTTCAACGATAAAAGCGACAAAGAGCTGTCTGAT
GAAGCAGCCAAACTGAAGAATGTAGTGGGACACCACGAGGCAGCG
ACGAATATAGTCAAGGACTATCGCTACACGTATGATAAATACTTC
CTTCATATGCCTATTACGATCAATTTCAAAGCCAATAAAACGGGT
TTTATTAATGATAGGATCTTACAGTATATCGCTAAAGAAAAAGAC
TTACATGTGATCGGCATTGATCGGGGCGAGCGTAACCTGATCTAC
GTGTCCGTGATTGATACTTGTGGTAATATAGTTGAACAGAAAAGC

-continued

TTTAACATTGTAAACGGCTACGACTATCAGATAAAACTGAAACAA
CAGGAGGGCGCTAGACAGATTGCGCGGAAAGAATGGAAAGAAATT
GGTAAAATTAAAGAGATCAAAGAGGGCTACCTGAGCTTAGTAATC
CACGAGATCTCTAAAATGGTAATCAAATACAATGCAATTATAGCG
ATGGAGGATTTGTCTTATGGTTTTAAAAAGGGCGCTTTAAGGTC
GAACGGCAAGTTTACCAGAAATTTGAAACCATGCTCATCAATAAA
CTCAACTATCTGGTATTTAAAGATATTTCGATTACCGAGAATGGC
GGTCTCCTGAAAGGTTATCAGCTGACATACATTCCTGATAAACTT
AAAAACGTGGGTCATCAGTGCGGCTGCATTTTTTATGTGCCTGCT
GCATACACGAGCAAAATTGATCCGACCACCGGCTTTGTGAATATC
TTTAAATTTAAAGACCTGACAGTGGACGCAAAACGTGAATTCATT
AAAAAATTTGACTCAATTCGTTATGACAGTGAAAAAAATCTGTTC
TGCTTTACATTTGACTACAATAACTTTATTACGCAAAACACGGTC
ATGAGCAAATCATCGTGGAGTGTGTATACATACGGCGTGCGCATC
AAACGTCGCTTTGTGAACGGCCGCTTCTCAAACGAAAGTGATACC
ATTGACATAACCAAAGATATGGAGAAAACGTTGGAAATGACGGAC
ATTAACTGGCGCGATGGCCACGATCTTCGTCAAGACATTATAGAT
TATGAAATTGTTCAGCACATATTCGAAATTTTCCGTTTAACAGTG
CAAATGCGTAACTCCTTGTCTGAACTGGAGGACCGTGATTACGAT
CGTCTCATTTCACCTGTACTGAACGAAAATAACATTTTTTATGAC
AGCGCGAAAGCGGGGGATGCACTTCCTAAGGATGCCGATGCAAAT
GGTGCGTATTGTATTGCATTAAAAGGGTTATATGAAATTAAACAA
ATTACCGAAAATTGGAAAGAAGATGGTAAATTTTCGCGCGATAAA
CTCAAAATCAGCAATAAAGATTGGTTCGACTTTATCCAGAATAAG
CGCTATCTCTAA

Exemplary nucleotide sequences coding for SEQ ID NO: 1 can include, e.g., SEQ ID NOs: 23-42:

SEQ ID NO: 23

ATGAACAACGGAACAAATAATTTTCAGAACTTTATTGGGATCAGTTCGCTTCAGAAAACG
CTTCGTAATGCTCTGATTCCCACAGAAACCACTCAGCAGTTTATCGTAAAGAATGGCATT
ATCAAGGAGGATGAATTACGCGGCGAGAACCGCCAAATCTTAAAAGATATCATGGACGAC
TACTACCGCGGTTTCATTAGCGAAACTCTTAGTTCAATTGACGACATTGACTGGACGTCC
TTGTTCGAAAAGATGGAGATTCAATTAAAGAACGGTGATAACAAGGATACGTTGATTAAA
GAACAGACGGAGTACCGTAAGGCTATCCACAAAAAATTTGCAAACGACGACCGCTTTAAA
AATATGTTTAGCGCAAAATTAATCTCCGACATCCTGCCTGAATTCGTCATCCATAACAAT
AACTATAGCGCCTCGGAAAAAGAAGAAAAAACGCAGGTTATTAAACTTTTCTCGCGCTTT
GCAACAAGCTTTAAGGATTACTTCAAAAATCGCGCCAATTGTTTTTCAGCCGACGACATT
AGCTCCAGTTCCTGCCACCGTATTGTGAATGACAACGCTGAGATTTTTTTTTCCAATGCG
CTGGTTTATCGTCGTATTGTTAAGAGCCTTAGTAACGACGACATTAATAAAATTAGCGGT
GATATGAAGGATAGCTTGAAAGAAATGAGTCTGGAAGAGATCTATAGTTACGAGAAGTAC
GGCGAATTTATTACCCAGGAGGGCATTTCATTTTACAATGATATCTGTGGAAAAGTCAAC

-continued

TCCTTTATGAACTTGTATTGCCAAAAGAATAAAGAAAACAAAAACCTGTACAAACTGCAA

AAGTTACACAAGCAGATTTTGTGTATCGCAGACACGTCATACGAAGTACCGTACAAGTTT

GAGTCCGATGAAGAAGTGTACCAAAGCGTTAATGGCTTTTTGGATAACATTTCGAGCAAA

CATATCGTAGAGCGTTTGCGTAAGATTGGTGATAATTACAACGGTTACAATTTAGACAAA

ATCTATATCGTCTCTAAGTTTTACGAAAGTGTTTCTCAGAAAACTTACCGCGATTGGGAG

ACGATCAACACTGCGCTGGAGATTCATTACAATAATATCCTTCCAGGTAACGGTAAAAGC

AAAGCTGATAAGGTGAAAAAGGCGGTTAAAAATGACCTTCAAAAGTCTATCACAGAAATC

AACGAATTGGTCAGCAATTATAAGCTTTGCAGTGACGATAACATTAAGGCCGAGACTTAC

ATCCATGAGATCTCTCACATTCTTAATAATTTTGAAGCGCAAGAGCTGAAATACAATCCT

GAAATCCATCTGGTCGAAAGTGAATTAAAAGCCTCCGAATTAAAAAATGTCTTGGACGTG

ATCATGAATGCGTTCCATTGGTGCTCAGTTTTTATGACGGAAGAGTTGGTGGACAAAGAC

AACAATTTTTACGCCGAGCTTGAGGAAATTTACGACGAAATTTACCCCGTTATTTCGTTA

TACAACCTTGTGCGTAATTACGTTACACAAAAGCCCTATTCGACAAAGAAAATCAAGTTA

AATTTCGGGATTCCCACATTAGCTGATGGATGGTCCAAATCCAAAGAATACTCGAATAAC

GCTATCATCCTTATGCGTGATAATTTGTACTACTTAGGCATCTTCAATGCGAAGAACAAA

CCTGACAAGAAAATTATCGAAGGAAACACTTCGGAGAACAAAGGTGATTATAAAAAGATG

ATCTACAACTTGCTTCCCGGGCCAAACAAAATGATTCCCAAGGTATTTTTGAGTTCTAAA

ACCGGTGTCGAAACTTACAAACCAAGTGCTTATATTTTGGAAGGATACAAACAGAACAAA

CATATCAAGTCTTCGAAAGACTTCGATATTACGTTCTGCCACGATCTGATCGATTACTTC

AAGAACTGTATTGCTATTCACCCCGAGTGGAAGAACTTTGGATTTGATTTCTCCGACACG

TCCACTTATGAAGATATCTCTGGCTTCTATCGCGAGGTTGAATTACAAGGGTATAAGATT

GACTGGACTTATATTTCGGAGAAGGATATCGATCTTTTGCAAGAAAAAGGGCAACTTTAT

TTATTTCAGATCTATAACAAGGACTTTTCAAAAAAGAGCACTGGAAATGACAATCTGCAT

ACCATGTACCTTAAGAACCTGTTCTCGGAAGAGAACCTGAAGGACATTGTACTTAAACTG

AATGGAGAGGCAGAGATCTTCTTTCGCAAATCAAGCATTAAGAACCCAATTATTCACAAA

AAGGGGAGTATCTTAGTAAATCGCACATATGAGGCTGAGGAAAAAGATCAGTTTGGTAAC

ATTCAGATCGTGCGTAAGAACATTCCTGAAAATATCTATCAGGAACTTTATAAGTATTTC

AACGATAAAAGTGATAAAGAGCTGAGTGACGAAGCGGCTAAACTTAAGAATGTTGTGGGA

CACCATGAGGCAGCAACCAATATTGTGAAGGATTATCGCTATACGTACGACAAATACTTT

TTACACATGCCCATCACTATTAATTTTAAAGCTAATAAGACTGGCTTCATTAACGATCGC

ATCCTGCAGTACATTGCTAAGGAAAAGGATCTTCACGTTATCGGTATCGATCGCGGGGAG

CGTAATCTTATCTACGTCTCTGTCATTGACACGTGTGGCAATATTGTGGAGCAAAAGTCC

TTCAATATTGTTAACGGCTATGACTATCAGATTAAATTGAAACAGCAGGAAGGTGCGCGT

CAGATTGCCCGCAAGGAATGGAAGGAAATTGGCAAGATCAAAGAAATTAAGGAGGGCTAC

TTAAGCTTAGTAATTCACGAAATTAGTAAAATGGTTATCAAATACAACGCCATCATCGCG

ATGGAGGATCTTTCGTACGGGTTTAAGAAAGGTCGTTTTAAAGTGGAGCGTCAGGTGTAC

CAGAAATTTGAAACTATGCTTATTAACAAACTTAACTACCTGGTTTTCAAGGATATCAGT

ATTACTGAAAACGGGGGGCTGTTAAAAGGGTATCAATTAACTTACATTCCAGACAAATTA

AAGAACGTTGGACATCAGTGTGGCTGCATTTTTTATGTACCAGCTGCATACACTTCAAAG

ATCGATCCTACGACTGGGTTCGTGAACATTTTTAAGTTTAAAGACTTGACGGTAGATGCC

-continued

AAGCGCGAATTCATCAAGAAATTCGACAGCATTCGCTACGACTCTGAGAAAAATCTTTTC
TGTTTCACATTCGATTATAACAATTTCATTACGCAGAACACAGTAATGTCCAAGTCTTCT
TGGAGTGTTTATACATATGGTGTCCGCATTAAGCGCCGTTTCGTCAACGGCCGCTTCAGT
AATGAGAGCGATACTATTGACATCACAAAAGACATGGAAAAAACACTGGAAATGACCGAC
ATCAATTGGCGTGACGGCCATGACTTACGTCAGGATATCATTGATTATGAGATCGTTCAA
CACATCTTCGAAATCTTTCGCTTGACTGTTCAAATGCGCAATTCCTTGTCGGAATTGGAG
GACCGTGATTATGACCGCTTAATTTCCCCCGTCTTAAATGAAAACAATATTTTTTATGAC
TCTGCAAAAGCTGGAGATGCTCTGCCGAAAGACGCCGATGCAAATGGGGCATATTGCATT
GCTTTAAAGGGGCTTTACGAGATCAAGCAAATCACCGAAAACTGGAAAGAGGATGGAAAG
TTTTCGCGTGATAAACTGAAGATCTCTAACAAAGACTGGTTCGACTTTATCCAGAACAAG
CGTTATTT

SEQ ID NO: 24

ATGAACAACGGCACCAATAACTTCCAAAACTTCATCGGGATCTCTAGCCTTCAGAAGACG
CTTCGCAATGCTCTTATCCCAACTGAGACCACTCAACAATTTATTGTGAAGAATGGAATT
ATTAAAGAGGACGAACTGCGTGGCGAGAATCGTCAGATCTTAAAGGACATTATGGATGAT
TATTACCGTGGATTCATCTCCGAAACATTATCGTCGATCGATGATATCGATTGGACTTCT
CTGTTCGAGAAAATGGAAATTCAATTGAAAAACGGAGATAATAAAGATACGCTTATCAAA
GAACAGACGGAATATCGTAAAGCGATTCATAAGAAATTCGCAAATGACGATCGTTTCAAA
AATATGTTCAGTGCCAAGCTTATTTCGGACATTTTACCTGAATTTGTAATTCATAATAAT
AACTACTCAGCAAGTGAGAAGGAGGAGAAAACCCAAGTTATTAAACTGTTCTCTCGTTTC
GCAACGTCCTTTAAAGATTACTTTAAAAACCGCGCGAATTGCTTTAGCGCTGACGACATT
TCCAGCTCATCCTGTCATCGCATCGTAAACGACAATGCGGAAATCTTCTTCAGCAACGCC
CTGGTTTACCGCCGCATCGTCAAAAGCTTATCGAATGACGACATCAATAAGATCTCAGGA
GATATGAAGGACTCGCTTAAGGAGATGTCTCTGGAGGAAATTTATAGTTACGAAAAGTAT
GGAGAGTTCATTACCCAGGAGGGAATCTCGTTCTACAATGACATTTGCGGGAAGGTGAAC
TCCTTCATGAACTTATACTGCCAGAAAAACAAAGAGAACAAAAATCTGTATAAATTGCAG
AAATTACATAAACAGATTCTTTGTATTGCTGACACTTCCTACGAAGTACCCTATAAATTC
GAGTCAGATGAAGAAGTATACCAGTCCGTGAACGGATTTCTGGACAATATCTCCTCAAAA
CACATCGTGGAACGCTTACGTAAAATTGGCGATAATTATAATGGTTACAATCTTGACAAA
ATTTATATCGTATCTAAATTTTACGAGAGTGTGAGCCAAAAGACCTACCGCGACTGGGAG
ACCATCAACACAGCTTTAGAAATTCACTATAATAATATCTTACCCGGCAATGGTAAGAGC
AAGGCTGACAAGGTAAAAAAGGCCGTCAAGAATGATTTGCAGAAATCTATTACAGAAATT
AATGAGTTAGTCTCCAACTATAAGCTTTGTTCCGACGATAACATCAAAGCTGAGACATAT
ATTCATGAGATTAGTCACATTCTTAACAACTTCGAGGCCCAGGAACTTAAGTACAATCCT
GAAATTCATCTTGTCGAGTCTGAGCTGAAAGCTAGTGAATTGAAAAATGTTTTAGACGTT
ATTATGAACGCATTCCACTGGTGCTCTGTGTTTATGACAGAAGAACTGGTCGACAAGGAC
AATAACTTCTATGCCGAACTTGAGGAAATCTACGATGAAATTTACCCTGTAATCTCCTTG
TATAATCTTGTACGTAATTACGTCACTCAAAAACCTTACAGCACGAAAAAAATTAAATTG
AACTTCGGGATTCCTACACTTGCCGACGGGTGGTCTAAATCCAAGGAATATAGCAACAAT
GCCATTATTTTAATGCGCGACAATCTTTACTATTTAGGAATTTTTAACGCTAAGAACAAG
CCCGATAAAAAGATTATTGAAGGAAACACGTCTGAAAATAAGGGCGACTACAAAAAGATG

-continued

ATTTATAACCTTTTGCCCGGTCCAAACAAAATGATCCCAAAGGTATTCCTGTCATCCAAA

ACAGGGGTTGAGACATATAAGCCCAGCGCATATATTCTGGAAGGATACAAACAGAATAAA

CATATCAAAAGCAGCAAAGATTTTGACATTACTTTTTGCCACGATTTAATCGACTACTTC

AAAAACTGTATCGCTATCCACCCTGAATGGAAGAATTTCGGATTTGATTTCTCAGATACA

AGTACGTATGAGGATATCAGCGGTTTCTATCGCGAAGTTGAACTTCAAGGGTATAAAATT

GACTGGACCTACATTAGTGAGAAGGACATCGACCTGTTACAGGAAAAAGGCCAATTGTAC

TTGTTTCAGATCTACAATAAGGATTTCTCAAAAAAATCGACCGGCAATGATAACTTGCAC

ACCATGTACCTGAAGAACCTTTTTTCGGAGGAAAACCTTAAAGACATTGTCCTGAAGTTG

AATGGAGAAGCGGAGATTTTCTTTCGTAAGTCTTCCATTAAAAATCCAATTATTCATAAG

AAGGGCAGCATCCTTGTGAACCGTACGTACGAGGCGGAAGAGAAGGACCAATTCGGTAAC

ATTCAAATCGTCCGCAAGAACATCCCTGAAAATATTTATCAGGAGCTTTACAAGTATTTC

AATGATAAGTCCGACAAGGAATTATCAGATGAGGCTGCGAAGTTGAAAAATGTTGTTGGT

CATCACGAGGCGGCGACGAATATTGTAAAGGATTATCGCTACACTTATGACAAGTACTTT

CTGCACATGCCGATCACCATTAATTTCAAGGCGAACAAAACAGGATTTATTAATGACCGC

ATCTTACAATACATTGCCAAAGAAAAGGACTTACACGTTATTGGCATTGATCGTGGAGAA

CGCAACTTAATCTACGTAAGCGTTATTGACACTTGCGGGAATATCGTAGAACAAAAGAGC

TTCAACATCGTGAATGGTTACGATTACCAGATCAAGCTTAAGCAGCAGGAGGGAGCGCGC

CAGATCGCGCGCAAGGAATGGAAGGAGATTGGTAAGATCAAGGAAATCAAGGAAGGTTAT

CTGTCCTTGGTAATCCACGAAATTTCGAAAATGGTTATCAAATACAATGCTATTATTGCA

ATGGAGGACTTGTCCTACGGCTTTAAAAAAGGACGCTTTAAGGTGGAGCGCCAGGTTTAT

CAAAAGTTTGAAACAATGCTGATTAACAAGCTGAACTATTTGGTCTTTAAAGATATCTCC

ATCACCGAAAATGGTGGGCTTTTGAAAGGCTATCAACTTACATATATCCCTGATAAGCTT

AAGAATGTGGGTCATCAGTGCGGGTGCATTTTTTATGTTCCTGCAGCCTACACGTCCAAA

ATCGATCCTACAACTGGATTTGTTAATATCTTCAAATTTAAGGATCTTACCGTCGACGCG

AAGCGCGAATTTATCAAGAAATTCGATAGTATTCGTTATGATTCCGAAAAAAACCTTTTC

TGTTTCACCTTTGATTATAATAACTTTATCACGCAAAATACTGTCATGAGCAAATCGAGT

TGGTCTGTGTACACTTACGGAGTACGCATCAAGCGTCGTTTTGTTAATGGGCGCTTCAGT

AACGAGTCAGACACGATTGATATCACAAAAGATATGGAGAAAACGCTGGAGATGACAGAC

ATCAATTGGCGCGATGGTCATGACTTACGTCAAGACATTATCGATTATGAAATTGTCCAG

CATATCTTTGAGATCTTTCGTTTGACTGTTCAGATGCGCAACAGCCTGTCAGAATTGGAG

GATCGTGACTATGATCGCCTTATTTCTCCCGTCTTAAATGAGAACAATATCTTCTACGAC

TCAGCCAAGGCTGGAGATGCACTGCCAAAAGACGCCGACGCAAATGGGGCCTACTGTATT

GCATTGAAGGGGTTGTACGAGATCAAACAGATTACAGAAAATTGGAAGGAGGACGGTAAG

TTCTCTCGTGATAAGCTGAAGATTTCTAACAAAGACTGGTTCGATTTCATTCAGAACAAA

CGTTACCTG

SEQ ID NO: 25

ATGAACAACGGTACCAATAACTTTCAGAATTTCATTGGAATCAGCAGCTTACAGAAAACC

CTGCGCAATGCACTTATCCCCACTGAGACAACCCAGCAGTTCATTGTAAAGAACGGGATT

ATTAAAGAAGATGAGCTTCGCGGGGAGAATCGTCAGATCTTAAAGGATATTATGGACGAT

TACTACCGTGGCTTCATTTCGGAGACGCTGTCGTCGATCGACGACATCGACTGGACATCC

TTGTTTGAAAAGATGGAAATCCAACTGAAGAATGGCGATAACAAGGACACGTTAATCAAA

-continued

```
GAGCAGACGGAATACCGTAAAGCTATCCACAAAAAGTTCGCTAATGACGACCGCTTTAAG

AACATGTTCTCAGCAAAACTTATTAGCGATATTTTACCTGAATTTGTCATCCACAATAAC

AATTACTCCGCGAGTGAAAAAGAGGAGAAAACCCAGGTGATTAAGCTGTTTTCCCGTTTT

GCAACCAGTTTCAAGGACTATTTTAAGAATCGTGCTAATTGTTTCTCTGCAGACGACATT

TCCTCGTCGTCCTGCCATCGCATTGTTAATGATAATGCTGAAATCTTTTTTTCAAACGCA

CTTGTGTATCGTCGCATTGTCAAAAGCTTAAGTAATGACGATATCAATAAGATCTCAGGA

GACATGAAGGACTCCCTGAAAGAAATGTCATTGGAAGAAATTTACTCTTATGAAAAGTAT

GGAGAATTTATTACGCAGGAGGGTATCAGCTTCTATAACGACATTTGTGGTAAAGTGAAC

AGCTTTATGAATCTTTATTGTCAAAAGAATAAAGAGAACAAAAATCTGTACAAGCTGCAG

AAATTGCATAAACAAATTCTGTGCATTGCAGATACTTCGTATGAGGTTCCTTACAAATTC

GAGTCGGATGAGGAGGTGTATCAAAGCGTAAACGGATTTTTGGATAACATTAGTAGTAAG

CATATTGTGGAACGCCTTCGCAAGATTGGTGACAACTATAACGGATACAACTTAGACAAG

ATCTATATTGTCTCGAAGTTTTACGAAAGTGTTTCCCAAAAGACTTATCGCGACTGGGAG

ACAATCAACACTGCGCTGGAAATTCACTATAACAATATCTTGCCGGGGAACGGAAAAAGT

AAGGCAGATAAGGTGAAGAAAGCAGTCAAAAATGATCTGCAAAAAAGCATTACTGAAATT

AACGAACTTGTGTCAAATTACAAATTGTGTTCGGATGACAATATTAAAGCGGAAACGTAT

ATCCACGAGATCTCGCACATTCTTAATAATTTCGAGGCGCAGGAATTAAAGTATAATCCT

GAGATCCATTTGGTGGAATCAGAACTTAAAGCTAGTGAACTGAAAAATGTCCTGGACGTT

ATTATGAATGCATTTCACTGGTGTTCTGTCTTTATGACAGAAGAACTTGTCGACAAAGAC

AACAACTTTTATGCGGAATTAGAAGAGATTTACGACGAAATTTATCCCGTTATTTCGTTA

TATAATTTAGTTCGTAATTACGTGACTCAGAAACCCTACAGCACAAAAAAGATTAAATTA

AACTTTGGGATTCCGACTCTTGCTGATGGATGGAGCAAGTCCAAGGAGTACTCTAATAAC

GCCATTATCTTGATGCGTGACAACCTGTACTACCTGGGCATTTTTAACGCTAAAAACAAA

CCCGACAAAAAGATCATTGAAGGGAACACCTCGGAAAATAAGGGGGACTATAAAAAAATG

ATCTACAATCTGTTGCCAGGCCCAAATAAGATGATCCCAAAGGTTTTTTTATCTTCCAAA

ACTGGCGTAGAAACTTACAAGCCGAGCGCATACATCCTTGAAGGATATAAACAAAACAAA

CATATCAAAAGTTCAAAGGACTTCGATATTACGTTCTGCCATGATTTAATCGATTATTTC

AAGAATTGCATCGCGATTCACCCAGAGTGGAAAAACTTTGGGTTTGATTTTTCAGACACC

AGCACTTACGAGGATATTAGTGGATTCTATCGTGAGGTTGAACTGCAGGGCTATAAAATT

GACTGGACCTATATTTCTGAAAAAGATATTGATCTGCTTCAGGAGAAAGGCCAATTGTAC

TTATTTCAAATCTATAACAAGGATTTCTCCAAGAAGTCCACGGGTAATGACAACTTACAC

ACAATGTATCTGAAGAATCTGTTTAGTGAGGAGAACTTGAAGGACATTGTGCTGAAGCTT

AATGGCGAGGCCGAAATCTTTTTTCGTAAGTCCTCCATTAAAAACCCTATTATCCATAAG

AAAGGGAGTATTCTTGTCAACCGCACGTATGAGGCCGAAGAAAAGGACCAATTCGGAAAC

ATCCAAATTGTCCGTAAAAATATTCCTGAGAACATTTACCAGGAGCTTTACAAGTATTTC

AACGACAAGAGTGATAAAGAACTTTCAGATGAGGCGGCGAAACTGAAGAATGTAGTGGGG

CACCACGAAGCTGCCACGAATATTGTAAAGGATTACCGTTACACCTACGACAAGTACTTT

TTGCATATGCCCATCACAATTAATTTTAAGGCCAATAAAACTGGTTTTATCAACGATCGT

ATCTTACAGTACATTGCTAAGGAAAAAGATCTGCACGTTATCGGTATCGATCGCGGGGAA

CGCAATCTGATTTATGTTAGTGTGATTGACACGTGCGGAAATATTGTTGAGCAGAAGAGC

TTTAATATCGTAAATGGATATGACTATCAAATTAAACTGAAGCAACAGGAAGGGGCCCGC
```

-continued

CAGATTGCCCGCAAGGAGTGGAAAGAAATTGGAAAGATCAAGGAGATTAAAGAAGGGTAC

CTTTCCCTTGTTATCCACGAAATCTCGAAAATGGTGATCAAGTACAATGCCATTATTGCT

ATGGAGGATCTGTCATATGGGTTTAAGAAAGGCCGCTTTAAGGTGGAACGTCAGGTTTAC

CAGAAGTTTGAGACCATGCTTATCAATAAGCTGAATTATCTTGTCTTCAAAGACATCTCA

ATCACAGAGAACGGCGGGCTGTTAAAAGGATATCAGCTGACCTATATCCCCGACAAACTG

AAAAATGTCGGGCACCAATGCGGCTGTATTTTCTACGTGCCCGCTGCATACACATCTAAA

ATTGACCCAACGACTGGATTCGTAAATATTTTTAAGTTTAAGGATCTTACGGTAGATGCA

AAGCGCGAATTTATCAAGAAATTTGATAGTATCCGTTACGACAGCGAGAAAAACTTATTT

TGTTTTACGTTCGATTATAACAACTTCATCACGCAAAATACCGTCATGTCAAAATCTTCC

TGGTCAGTCTATACGTATGGCGTCCGTATCAAGCGCCGCTTCGTCAACGGGCGTTTTTCA

AACGAGTCAGATACCATCGATATCACCAAAGATATGGAAAAAACATTGGAGATGACGGAC

ATCAATTGGCGCGATGGTCATGACTTACGCCAGGACATTATTGACTACGAAATCGTACAA

CATATTTTTGAGATTTTCCGTCTGACCGTGCAAATGCGCAACTCATTATCCGAACTTGAG

GATCGTGATTACGACCGCTTGATCAGTCCTGTTCTGAACGAGAATAATATTTTTTACGAC

AGTGCCAAGGCGGGAGACGCACTGCCCAAGGACGCTGACGCTAACGGAGCTTATTGTATT

GCGTTGAAGGGACTTTACGAAATCAAGCAAATCACTGAAAACTGGAAGGAGGATGGTAAA

TTCTCACGCGACAAGTTGAAAATTTCGAACAAGGACTGGTTCGATTTCATCCAAAACAAG

CGTTATTTA

SEQ ID NO: 26

ATGAACAACGGGACTAATAACTTCCAGAACTTCATCGGTATTTCATCATTACAAAAAACG

CTTCGTAACGCCTTGATCCCAACAGAAACGACCCAACAATTTATTGTAAAAAACGGCATC

ATCAAAGAAGACGAACTGCGTGGCGAAAATCGCCAAATTTTGAAGGACATTATGGATGAC

TATTATCGTGGGTTTATCTCGGAGACATTATCCTCCATCGACGACATTGATTGGACGAGT

CTTTTTGAGAAAATGGAGATCCAGCTTAAAAATGGTGATAACAAGGATACATTGATCAAG

GAGCAAACCGAGTACCGCAAGGCCATCCATAAGAAGTTCGCAAATGACGACCGCTTCAAA

AATATGTTTAGTGCCAAATTGATCTCGGATATCCTTCCTGAGTTCGTAATTCACAACAAT

AATTATAGCGCATCCGAAAAGGAGGAAAAGACTCAAGTCATTAAGCTTTTCAGTCGCTTT

GCTACCTCGTTTAAGGACTATTTCAAGAACCGCGCGAACTGCTTCTCAGCGGATGACATT

TCTTCCTCGTCGTGTCACCGCATCGTGAATGATAATGCGGAGATCTTCTTTAGTAATGCC

TTGGTATACCGCCGCATTGTTAAATCCCTGTCTAACGACGATATCAATAAGATCTCAGGA

GATATGAAGGATAGCCTTAAAGAAATGTCTCTGGAAGAAATTTACTCCTATGAAAAGTAC

GGTGAGTTTATCACCCAAGAGGGGATTAGCTTTTATAACGATATCTGCGGGAAGGTGAAT

TCGTTTATGAACCTTTATTGTCAAAAGAATAAGGAGAATAAGAACTTATATAAGCTTCAG

AAACTGCATAAACAAATCTTATGCATTGCCGATACTAGCTATGAAGTTCCGTATAAATTC

GAGAGCGATGAAGAAGTTTATCAGAGCGTCAATGGGTTCTTGGATAACATTTCATCAAAA

CACATCGTGGAACGTCTGCGTAAGATTGGGGATAACTACAACGGATATAATCTTGACAAA

ATTTATATTGTATCTAAATTCTATGAGTCGGTGAGTCAAAAGACCTACCGTGATTGGGAA

ACAATCAATACCGCGTTAGAAATCCACTATAACAACATTCTGCCAGGGAATGGTAAAAGT

AAAGCGGACAAAGTCAAGAAGGCTGTGAAGAACGATCTGCAAAAGAGTATTACAGAGATT

AACGAATTAGTCTCCAATTATAAGTTATGCTCGGACGATAACATTAAGGCGGAGACGTAT

ATTCATGAGATTTCGCATATTCTTAACAACTTCGAGGCACAAGAGCTTAAGTATAACCCA

-continued

GAGATTCACCTTGTCGAATCGGAGCTGAAGGCATCGGAATTAAAAAATGTCTTAGATGTA

ATCATGAACGCGTTCCATTGGTGCAGTGTTTTCATGACTGAGGAGTTAGTTGACAAGGAC

AATAACTTCTACGCAGAATTAGAAGAGATCTATGATGAGATTTATCCAGTGATTTCGCTG

TATAATCTGGTACGTAATTACGTCACTCAAAAGCCCTACTCAACAAAAAAAATTAAGCTG

AACTTCGGAATTCCGACTCTGGCCGACGGGTGGTCCAAGTCAAAGGAGTATTCTAATAAT

GCTATCATCCTGATGCGCGATAACTTATACTATTTGGGAATTTTCAATGCCAAAAATAAA

CCAGATAAAAAGATTATCGAAGGTAATACAAGCGAGAATAAGGGTGACTATAAGAAAATG

ATTTACAATCTTCTTCCAGGCCCTAACAAGATGATTCCCAAAGTTTTTTTGTCCAGTAAA

ACAGGGGTCGAAACTTACAAGCCCAGTGCCTATATCCTTGAAGGGTACAAGCAGAATAAG

CACATCAAATCCTCGAAAGACTTTGATATTACATTTTGTCATGACTTAATCGATTATTTT

AAGAACTGTATCGCAATCCATCCAGAATGGAAGAACTTCGGGTTTGATTTCTCTGATACT

TCCACGTATGAGGATATTTCCGGGTTCTACCGCGAAGTAGAGCTTCAGGGCTATAAAATT

GACTGGACATATATTTCAGAAAAAGACATCGATCTGTTACAAGAAAAAGGACAGTTGTAT

CTGTTTCAAATCTATAATAAGGATTTCTCCAAAAAGTCAACTGGAAATGATAACTTACAT

ACAATGTATCTGAAAAATCTTTTTAGTGAAGAGAATTTGAAGGATATCGTGCTGAAGTTA

AATGGCGAAGCAGAGATCTTCTTCCGCAAGTCCTCGATCAAGAATCCTATCATCCACAAG

AAAGGTAGTATTCTGGTTAACCGCACGTACGAGGCCGAGGAAAAAGACCAGTTCGGTAAT

ATCCAGATTGTACGTAAGAATATTCCTGAAAATATTTACCAGGAATTATACAAGTATTTT

AACGACAAATCGGATAAGGAGCTTTCAGATGAGGCCGCAAAGTTGAAGAACGTCGTAGGA

CACCATGAGGCCGCTACGAATATCGTCAAGGACTACCGCTATACGTATGACAAGTACTTC

CTGCACATGCCTATTACTATCAATTTCAAAGCTAATAAAACAGGATTCATCAATGATCGT

ATCCTTCAGTACATTGCCAAAGAAAAAGATCTGCACGTAATCGGAATCGACCGTGGCGAA

CGTAATCTGATTTACGTATCAGTTATCGACACATGTGGTAACATCGTGGAGCAGAAATCT

TTTAACATTGTTAACGGCTATGATTATCAGATTAAGCTTAAACAGCAGGAGGGGGCACGC

CAAATCGCTCGTAAAGAATGGAAGGAGATTGGAAAGATTAAAGAGATTAAAGAGGGGTAC

CTTTCGCTGGTTATTCACGAAATTTCCAAGATGGTGATTAAGTACAATGCAATCATCGCG

ATGGAAGATCTTAGTTACGGATTCAAAAAGGGACGCTTCAAAGTTGAGCGTCAGGTCTAC

CAGAAATTTGAAACGATGCTGATTAACAAATTGAATTACTTGGTATTCAAAGATATCTCA

ATTACTGAAAATGGTGGCTTATTAAAGGGTTACCAGCTTACCTATATCCCGGATAAGCTG

AAGAACGTGGGCCATCAATGCGGCTGCATCTTTTACGTCCCTGCCGCATATACCTCTAAA

ATTGACCCCACCACCGGATTCGTAAATATTTTTAAATTCAAGGACCTGACGGTGGACGCC

AAGCGCGAATTCATCAAAAAATTCGACTCAATCCGCTATGATTCCGAAAAAAATCTTTTC

TGCTTTACGTTCGATTATAATAACTTCATTACCCAAAACACGGTGATGTCAAAATCGTCC

TGGAGCGTGTATACTTATGGAGTGCGTATCAAGCGCCGCTTTGTTAATGGGCGCTTCAGT

AACGAAAGCGATACCATCGACATTACCAAAGACATGGAGAAGACGCTTGAAATGACGGAT

ATCAATTGGCGTGACGGACACGATCTTCGTCAGGATATCATCGACTACGAGATTGTGCAA

CATATCTTTGAGATTTTCCGTTTAACTGTTCAAATGCGTAACTCCTTGTCCGAATTGGAA

GACCGTGATTACGACCGCTTGATTTCACCAGTGCTTAACGAGAATAACATCTTCTACGAC

-continued

TCCGCCAAAGCAGGCGATGCCCTGCCAAAGGACGCTGATGCAAATGGTGCATACTGTATC

GCGTTGAAGGGCTTATACGAGATTAAGCAAATCACCGAAAATTGGAAAGAGGATGGAAAG

TTCAGTCGCGATAAGCTGAAGATCTCTAATAAAGATTGGTTTGACTTTATCCAGAACAAA

CGTTATTTA

SEQ ID NO: 27

ATGAACAACGGTACCAATAATTTCCAAAATTTCATCGGAATCTCATCCTTGCAAAAAACC

TTGCGCAATGCTTTGATCCCCACCGAAACCACGCAGCAGTTCATCGTGAAAAACGGCATT

ATCAAAGAGGATGAGTTGCGCGGGGAAAACCGTCAAATTCTTAAGGATATCATGGACGAT

TACTACCGTGGGTTTATCAGTGAGACCCTGTCAAGCATTGACGACATTGACTGGACCAGC

TTATTTGAGAAGATGGAGATTCAATTAAAGAACGGGGACAATAAGGACACGCTTATCAAA

GAGCAGACAGAATACCGTAAAGCGATTCATAAGAAATTTGCAAATGACGATCGCTTCAAG

AACATGTTTTCAGCAAAATTAATCAGCGACATCCTTCCCGAATTTGTGATTCATAATAAC

AACTATTCGGCTAGCGAAAAAGAGGAGAAAACTCAGGTTATTAAGCTTTTCTCGCGTTTT

GCCACTTCGTTCAAAGACTATTTTAAGAATCGCGCAAACTGCTTTTCGGCTGATGATATT

TCCAGTTCTAGCTGCCATCGTATCGTTAACGATAATGCTGAGATTTTCTTCTCTAATGCC

CTGGTGTATCGTCGTATCGTTAAATCTTTGAGCAACGACGATATTAATAAGATTTCAGGC

GACATGAAGGATTCTTTAAAGGAGATGTCTTTAGAAGAGATTTATTCCTATGAGAAATAT

GGCGAGTTTATCACCCAAGAAGGAATTTCGTTCTACAACGACATCTGTGGCAAAGTGAAC

AGCTTCATGAATTTATACTGCCAAAAGAATAAGGAGAATAAAAATTTATATAAACTGCAG

AAACTGCATAAGCAAATTCTTTGCATTGCAGACACCTCTTATGAAGTTCCTTATAAGTTT

GAATCGGACGAGGAGGTATATCAGAGTGTGAACGGGTTCCTGGACAATATTTCATCCAAG

CATATTGTTGAACGTTTACGCAAAATTGGAGACAATTACAATGGGTATAACCTTGACAAA

ATTTACATCGTGTCGAAGTTTTACGAATCGGTAAGCCAGAAGACCTATCGTGACTGGGAA

ACTATCAATACCGCCTTAGAAATTCATTACAACAATATTCTTCCTGGTAACGGCAAAAGC

AAAGCCGATAAGGTAAAGAAGGCTGTCAAGAACGACCTGCAAAAGTCTATCACAGAGATC

AACGAGTTAGTCTCTAACTACAAATTATGTTCCGACGACAATATTAAAGCCGAAACCTAC

ATCCATGAGATCTCACACATTCTTAACAATTTTGAGGCCCAGGAGCTGAAATATAACCCA

GAAATTCACCTTGTAGAGAGCGAATTAAAAGCCTCCGAGCTGAAGAACGTTTTGGATGTA

ATCATGAACGCATTTCATTGGTGCAGCGTATTTATGACAGAGGAGTTGGTCGACAAGGAC

AATAACTTTTACGCCGAGCTTGAAGAAATCTACGATGAAATTTACCCGGTAATTAGTTTA

TATAATTTAGTTCGCAACTACGTAACTCAGAAACCCTACAGTACCAAGAAGATTAAATTG

AACTTTGGGATCCCGACACTTGCTGACGGTTGGAGTAAATCAAAAGAATACTCCAATAAT

GCAATTATCCTGATGCGCGACAATCTTTACTACTTGGGGATCTTTAACGCAAAGAACAAA

CCAGATAAGAAAATCATCGAGGGCAACACCAGCGAGAATAAAGGCGATTACAAGAAAATG

ATCTATAATCTTTTGCCGGGACCGAACAAAATGATCCCAAAGGTTTTCCTGTCGTCGAAA

ACGGGAGTCGAGACATATAAACCATCTGCGTACATCTTGGAAGGTTACAAACAGAATAAG

CATATTAAGTCTAGTAAAGACTTCGACATCACCTTTTGTCATGACCTGATTGATTATTTC

AAGAACTGTATTGCTATCCATCCAGAATGGAAAAACTTCGGATTTGACTTCTCCGATACT

AGCACCTACGAAGACATTTCGGGTTTTTATCGCGAAGTAGAGCTTCAAGGGTACAAAATT

GATTGGACATATATTAGCGAGAAAGACATTGATTTGCTTCAAGAGAAGGGACAGTTATAT

TTATTCCAGATCTACAACAAAGACTTCTCGAAGAAATCCACCGGTAATGATAATCTTCAC

-continued

ACTATGTACCTGAAGAATTTATTTTCAGAGGAAAATCTGAAGGACATTGTACTTAAACTT
AATGGAGAAGCCGAAATCTTCTTCCGCAAGAGTTCCATTAAAAATCCGATTATTCATAAA
AAGGGAAGTATCCTTGTGAACCGCACGTATGAGGCCGAAGAGAAGGATCAGTTTGGGAAT
ATTCAAATTGTCCGCAAAAACATCCCCGAGAACATCTACCAGGAACTGTATAAATACTTT
AATGATAAATCTGATAAAGAGTTATCAGACGAGGCTGCCAAACTGAAAAACGTAGTCGGT
CATCATGAGGCAGCGACCAATATTGTAAAGGACTACCGTTACACCTACGACAAGTATTTC
CTTCACATGCCGATCACGATTAATTTTAAGGCTAACAAGACCGGCTTTATCAATGACCGC
ATCTTGCAGTACATCGCGAAAGAGAAAGATTTACACGTCATCGGAATTGATCGTGGAGAG
CGTAATCTTATCTACGTCAGCGTCATCGACACCTGTGGAAACATTGTGGAACAAAAAAGT
TTTAATATCGTAAACGGCTACGACTATCAAATTAAACTTAAACAGCAAGAGGGAGCTCGC
CAGATCGCTCGCAAAGAGTGGAAAGAGATTGGGAAAATTAAAGAAATTAAAGAGGGTTAC
CTGTCGCTGGTAATTCACGAAATCTCGAAAATGGTCATCAAATATAATGCAATTATCGCT
ATGGAGGATCTGTCCTACGGGTTCAAGAAGGGACGTTTTAAAGTAGAGCGCCAGGTGTAT
CAAAAATTCGAAACCATGTTGATCAATAAGCTTAACTATTTGGTCTTCAAAGATATTTCG
ATTACGGAGAACGGAGGTTTGTTGAAAGGATATCAGCTGACGTATATCCCAGACAAGTTG
AAAAACGTGGGGCATCAATGTGGATGTATTTTCTATGTGCCCGCGGCCTACACGAGTAAG
ATCGATCCTACCACTGGTTTCGTCAACATTTTCAAATTTAAAGATCTTACCGTGGATGCG
AAGCGCGAATTTATTAAGAAATTTGATAGCATTCGCTATGATTCCGAAAAGAACCTGTTC
TGTTTTACGTTCGACTATAACAATTTCATTACCCAAAACACGGTGATGAGCAAATCCTCT
TGGTCAGTTTATACATACGGTGTACGTATCAAACGCCGTTTCGTTAACGGACGCTTTTCC
AATGAGTCTGATACAATCGATATCACGAAAGATATGGAAAAAACATTAGAGATGACTGAT
ATCAACTGGCGTGACGGGCACGACCTGCGTCAAGACATTATTGACTACGAGATTGTGCAG
CATATCTTCGAAATCTTTCGCTTAACTGTGCAAATGCGTAACTCGTTATCCGAGTTAGAA
GACCGTGACTACGATCGCCTGATTTCACCCGTCTTGAACGAAAATAACATCTTCTACGAT
TCCGCGAAGGCTGGGGACGCATTGCCCAAGGACGCAGACGCGAATGGAGCGTACTGTATT
GCGCTTAAAGGATTATATGAAATCAAGCAGATCACCGAAAATTGGAAGGAGGACGGGAAG
TTCTCACGCGACAAACTGAAGATTTCAAATAAGGACTGGTTCGATTTCATTCAGAATAAG
CGTTACCTG

SEQ ID NO: 28

TGAATAATGGTACGAACAACTTTCAGAACTTCATCGGCATCTCCAGCCTTCAAAAGACTT
TACGCAACGCATTGATTCCCACGGAGACTACGCAACAGTTTATCGTAAAAAATGGTATTA
TCAAAGAAGATGAATTACGCGGGGAGAATCGCCAGATTCTTAAGGACATTATGGACGATT
ATTACCGTGGATTCATCAGTGAGACACTGAGCTCCATTGATGACATCGACTGGACGTCAT
TGTTTGAAAAGATGGAAATCCAGTTGAAAAATGGCGATAACAAAGATACATTGATTAAAG
AGCAGACAGAGTACCGCAAAGCAATTCACAAGAAATTCGCCAATGATGATCGTTTTAAGA
ACATGTTTAGTGCCAAGCTTATTTCGGATATCTTACCCGAATTCGTGATTCACAACAACA
ATTATTCGGCAAGTGAGAAAGAGGAAAAGACCCAGGTTATCAAATTGTTTTCGCGCTTCG
CCACTTCGTTCAAAGATTATTTCAAGAACCGTGCAAACTGTTTCTCCGCTGACGACATCA
GTTCCAGCTCATGCCACCGTATTGTAAATGACAATGCGGAGATCTTTTTCAGTAATGCCT
TAGTATATCGTCGCATTGTAAAGAGCTTATCTAATGATGACATTAACAAGATCTCGGGTG
ATATGAAGGACTCACTTAAGGAGATGAGTCTGGAAGAGATCTACTCCTACGAAAAATACG

-continued

GGGAATTCATCACCCAGGAGGGAATTTCATTCTACAACGATATCTGCGGCAAAGTTAACT

CCTTTATGAATCTGTACTGTCAAAAGAACAAGGAGAATAAAAACCTGTATAAATTGCAGA

AACTTCATAAACAAATTTTGTGTATCGCAGACACGAGTTATGAAGTACCTTATAAATTCG

AATCCGACGAAGAGGTATATCAGTCCGTAAATGGGTTCCTGGACAATATCAGTAGTAAGC

ACATTGTGGAACGCTTACGCAAAATTGGAGACAATTACAACGGGTATAACCTGGACAAAA

TCTACATCGTATCCAAATTTTATGAAAGCGTGTCTCAAAAAACTTATCGTGATTGGGAAA

CAATCAACACGGCTCTTGAGATCCATTACAATAACATCTTGCCGGGTAACGGCAAATCGA

AGGCAGACAAAGTTAAAAAAGCAGTTAAGAACGACTTACAGAAAAGCATTACGGAGATTA

ACGAGTTAGTAAGTAATTACAAATTATGCTCCGACGATAATATCAAAGCTGAAACCTACA

TCCATGAAATTAGCCACATTTTGAACAATTTCGAAGCGCAGGAGCTGAAATATAACCCTG

AAATCCATCTGGTAGAGTCTGAGTTGAAGGCGTCAGAACTGAAAAACGTTCTTGACGTCA

TCATGAATGCCTTTCACTGGTGTAGTGTTTTTATGACTGAGGAGCTTGTAGATAAGGACA

ACAACTTCTATGCTGAACTTGAAGAGATCTACGATGAAATCTACCCCGTAATCAGTCTGT

ATAATTTAGTTCGTAACTACGTCACGCAGAAACCCTATTCGACTAAGAAAATTAAGCTGA

ACTTTGGGATCCCTACTTTGGCAGACGGGTGGAGCAAGAGTAAAGAATACAGTAATAATG

CAATTATCTTGATGCGCGATAACTTATATTACTTAGGTATTTTCAATGCTAAGAACAAAC

CTGATAAGAAGATTATCGAAGGAAATACGAGTGAGAATAAGGGAGACTACAAAAAGATGA

TTTACAACTTGCTGCCAGGGCCTAATAAGATGATTCCAAAAGTTTTTCTGTCGAGCAAGA

CAGGGGTTGAAACTTATAAGCCATCCGCTTATATCCTTGAGGGGTACAAGCAGAATAAGC

ATATCAAGTCCTCCAAAGATTTTGATATTACATTTTGCCACGACTTAATTGATTACTTCA

AGAACTGCATCGCAATCCATCCCGAATGGAAGAATTTCGGCTTCGATTTCTCAGATACGT

CCACGTATGAGGATATCTCAGGCTTTTACCGCGAAGTTGAGCTGCAAGGTTATAAAATTG

ATTGGACATACATCTCCGAAAAAGACATTGATCTTTTACAGGAAAAGGGCCAATTATACT

TATTTCAAATCTATAACAAAGATTTTAGCAAGAAGTCCACAGGTAATGATAACCTGCATA

CGATGTATTTGAAAAATCTTTTCAGTGAAGAGAATTTGAAGGATATCGTCCTGAAGCTGA

ACGGTGAGGCTGAGATCTTCTTCCGCAAATCGTCTATCAAAAACCCCATCATTCACAAAA

AGGGAAGTATCTTAGTAAACCGCACTTATGAAGCGGAGGAAAAGGATCAGTTCGGGAACA

TCCAGATCGTGCGCAAGAACATTCCAGAAAACATCTATCAGGAACTTTACAAATATTTCA

ATGACAAGTCTGATAAAGAATTATCAGACGAGGCGGCGAAACTTAAAAATGTTGTTGGAC

ACCACGAAGCAGCGACGAATATTGTAAAGGATTATCGCTACACATACGATAAATACTTTT

TGCACATGCCAATCACCATTAACTTTAAGGCGAACAAGACAGGTTTCATTAACGACCGTA

TTCTGCAATATATCGCAAAGGAAAAAGACCTGCACGTTATTGGGATCGATCGTGGCGAAC

GCAATTTGATCTACGTAAGCGTTATCGACACTTGCGGAAATATCGTTGAACAAAAAAGCT

TTAATATCGTCAATGGATACGATTACCAAATCAAGCTGAAACAACAAGAAGGGGCACGTC

AGATCGCTCGTAAAGAATGGAAAGAGATTGGTAAGATCAAAGAGATTAAAGAAGGGTATC

TTTCTTTAGTAATTCACGAGATTTCGAAAATGGTTATTAAATACAATGCGATTATTGCTA

TGGAAGACTTAAGCTACGGCTTTAAGAAAGGTCGCTTCAAAGTGGAGCGCCAAGTGTATC

AGAAGTTTGAAACGATGTTGATTAACAAATTAAATTACCTGGTCTTTAAGGACATCAGTA

TCACAGAAAATGGGGGGTTGCTTAAAGGGTACCAGCTTACATACATCCCTGATAAACTGA

AAAATGTCGGTCATCAGTGCGGATGTATCTTCTATGTACCAGCAGCCTATACCAGTAAGA

TTGACCCTACTACTGGCTTTGTGAATATTTTTAAATTCAAGGATTTAACCGTGGACGCCA

-continued

AGCGTGAATTTATTAAAAAATTTGATTCGATTCGCTACGACAGTGAGAAAAACCTTTTCT
GCTTTACCTTTGACTACAACAATTTTATTACCCAGAACACCGTAATGTCAAAGAGTTCGT
GGTCTGTATATACCTACGGTGTTCGCATCAAGCGCCGCTTCGTAAACGGGCGTTTCAGTA
ACGAATCTGACACCATCGACATCACTAAAGATATGGAGAAGACATTGGAAATGACGGACA
TTAATTGGCGTGATGGCCATGACTTACGTCAGGACATTATTGATTACGAAATTGTGCAGC
ATATCTTCGAGATTTTCCGTTTGACAGTTCAGATGCGCAACTCACTGAGTGAGTTAGAAG
ATCGCGATTACGACCGTCTGATCTCACCGGTCCTTAATGAAAACAACATTTTCTACGACT
CAGCAAAGGCGGGTGATGCCCTGCCAAAGGATGCGGACGCTAATGGCGCCTACTGCATCG
CCCTGAAAGGATTGTATGAAATTAAGCAGATTACAGAAAATTGGAAGGAAGATGGTAAAT
TTAGCCGTGATAAATTAAAAATCTCGAACAAGGATTGGTTCGATTTTATTCAGAACAAAC
GTTATTTG

SEQ ID NO: 29

ATGAACAATGGAACAAATAATTTTCAAAATTTTATCGGCATCTCAAGTCTTCAAAAAACC
CTTCGCAATGCCCTGATTCCAACTGAAACAACCCAGCAATTTATCGTCAAGAACGGCATC
ATTAAGGAAGACGAGTTACGCGGGGAGAACCGTCAAATCCTGAAAGATATCATGGATGAC
TACTATCGTGGGTTCATTTCGGAAACCTTGTCTTCAATCGACGACATTGACTGGACGAGT
CTTTTCGAGAAAATGGAAATTCAGCTTAAAAATGGAGACAACAAGGATACTCTGATTAAG
GAACAGACAGAATATCGCAAAGCTATCCACAAAAAGTTCGCTAATGATGATCGTTTCAAA
AATATGTTTTCTGCTAAATTGATTTCCGATATCTTGCCTGAATTTGTAATCCACAACAAC
AATTATTCTGCTTCCGAGAAGGAAGAGAAGACCCAGGTCATTAAATTATTCAGCCGCTTT
GCAACCAGCTTTAAAGACTACTTTAAGAATCGCGCTAACTGCTTTTCGGCGGATGACATC
TCATCATCATCATGCCACCGCATTGTGAACGACAATGCGGAGATCTTCTTTTCGAATGCG
TTAGTTTATCGTCGCATTGTCAAAAGTCTTAGCAATGATGACATCAACAAGATCTCAGGA
GACATGAAAGATTCCTTAAAGGAGATGTCTCTTGAGGAAATCTATTCGTATGAGAAATAC
GGCGAGTTCATTACCCAGGAAGGTATTAGTTTCTACAATGATATCTGCGGCAAAGTAAAT
TCTTTTATGAATCTGTATTGCCAAAAAAACAAAGAAAACAAGAATCTTTATAAGTTACAA
AAGTTACATAAGCAAATTCTGTGCATCGCTGATACATCTTATGAGGTACCCTACAAATTT
GAAAGTGATGAGGAGGTCTATCAGAGTGTCAACGGCTTCTTAGACAACATCTCTTCCAAA
CATATCGTGGAACGCCTGCGTAAAATCGGAGATAACTACAACGGATATAACTTAGATAAA
ATCTACATCGTGTCCAAGTTTTATGAAAGTGTGAGCCAAAAAACATATCGTGACTGGGAA
ACCATTAACACCGCATTGGAAATTCACTATAACAACATTTTGCCAGGCAACGGGAAAAGT
AAGGCGGACAAAGTTAAGAAAGCAGTTAAAAATGACCTGCAAAAAAGCATCACTGAAATT
AACGAATTGGTATCGAATTACAAATTATGTAGCGACGATAATATCAAAGCAGAAACTTAC
ATTCACGAGATTAGTCACATTTTAAATAACTTCGAGGCCCAGGAATTGAAATACAATCCC
GAAATTCATTTGGTTGAATCAGAACTGAAAGCATCAGAGTTGAAAAATGTGTTAGATGTC
ATTATGAATGCGTTTCATTGGTGCTCTGTGTTCATGACCGAGGAACTGGTTGATAAAGAT
AACAACTTTTACGCTGAATTGGAGGAGATTTACGATGAGATTTACCCGGTCATTTCGCTT
TATAACTTAGTGCGCAATTATGTGACGCAGAAACCATATTCCACGAAGAAAATCAAACTT
AATTTTGGCATCCCTACTCTGGCTGATGGTTGGTCGAAATCGAAAGAGTACAGCAACAAC
GCGATCATTCTTATGCGTGACAATCTTTACTATTTGGGCATTTTTAATGCCAAGAATAAG
CCAGATAAGAAAATCATTGAGGGGGAATACTTCCGAGAATAAGGGGGATTACAAAAAGATG

-continued

ATCTATAACTTGCTGCCCGGCCCCAACAAAATGATTCCTAAGGTTTTCTTGTCAAGCAAG

ACGGGCGTCGAAACATATAAGCCGTCAGCTTATATTCTGGAAGGCTATAAACAGAATAAG

CACATCAAGTCTTCCAAGGACTTTGACATCACTTTTTGCCACGATTTGATCGACTACTTT

AAGAACTGTATTGCGATTCATCCGGAATGGAAGAACTTCGGTTTCGACTTTTCCGATACC

TCAACATACGAGGATATCAGCGGCTTCTACCGTGAAGTCGAGCTTCAAGGCTACAAGATC

GATTGGACATATATTTCAGAGAAGGACATTGATTTGTTACAAGAGAAAGGTCAACTTTAC

TTATTTCAGATCTATAACAAAGACTTTTCGAAGAAATCGACAGGAAACGATAACTTACAC

ACTATGTATTTAAAAAATCTGTTTTCGGAGGAAAACCTGAAAGATATTGTGCTGAAACTT

AACGGCGAGGCAGAGATCTTTTTCCGTAAAAGCTCAATCAAGAATCCTATCATCCATAAA

AAAGGTAGTATTCTTGTCAACCGCACATATGAAGCGGAGGAGAAGGACCAATTCGGAAAC

ATCCAAATTGTCCGTAAGAATATTCCGGAGAACATTTACCAAGAGTTGTATAAATACTTT

AACGATAAGTCAGATAAGGAACTTAGCGATGAGGCGGCGAAGCTTAAAAACGTAGTTGGG

CATCATGAAGCTGCTACCAACATTGTAAAAGATTACCGTTACACCTATGACAAGTATTTC

TTGCACATGCCCATTACGATCAATTTCAAAGCAAATAAGACAGGCTTTATCAATGATCGC

ATCCTGCAGTACATTGCTAAAGAGAAGGATTTGCATGTTATCGGTATTGATCGCGGAGAG

CGCAATTTGATCTACGTCTCCGTAATCGACACTTGCGGTAACATTGTTGAGCAGAAGTCG

TTCAACATCGTTAATGGTTATGATTACCAAATCAAGCTGAAGCAGCAAGAGGGTGCCCGC

CAGATCGCGCGTAAGGAATGGAAAGAAATCGGGAAAATTAAAGAGATCAAAGAAGGCTAT

TTGTCTCTGGTAATTCACGAAATCAGCAAGATGGTGATCAAGTATAACGCGATCATTGCG

ATGGAGGATCTTTCTTATGGCTTCAAGAAAGGGCGCTTTAAAGTCGAACGCCAGGTCTAC

CAGAAATTTGAGACAATGCTTATCAACAAGCTTAACTATCTTGTATTTAAGGATATTTCC

ATCACTGAGAACGGAGGACTTTTAAAGGGGTACCAACTGACGTACATTCCTGATAAGCTG

AAGAACGTTGGTCATCAATGCGGATGCATCTTCTATGTGCCAGCGGCTTACACCTCCAAA

ATCGATCCCACTACAGGCTTTGTCAATATCTTCAAATTCAAGGATTTGACCGTTGACGCG

AAGCGCGAGTTTATCAAGAAGTTTGATAGCATTCGCTACGACAGCGAAAAAAATTTATTT

TGTTTTACTTTCGACTACAATAACTTTATTACTCAGAACACTGTCATGTCAAAGAGTTCG

TGGAGTGTCTACACGTACGGAGTACGTATTAAGCGCCGTTTCGTCAACGGACGCTTCTCA

AACGAAAGCGACACGATCGACATCACCAAAGACATGGAAAAAACTCTTGAGATGACGGAT

ATCAATTGGCGCGACGGCCATGACCTGCGTCAGGATATCATTGATTACGAGATCGTTCAG

CACATCTTCGAAATCTTCCGCCTTACCGTCCAGATGCGCAACAGTTTAAGCGAGCTTGAA

GACCGCGACTACGATCGTTTGATTAGCCCCGTTCTGAACGAGAATAATATTTTCTACGAC

AGCGCAAAGGCCGGTGATGCTTTGCCAAAGGACGCAGACGCGAATGGAGCCTACTGCATC

GCCCTGAAGGGCTTATATGAGATTAAGCAAATTACCGAAAATTGGAAGGAAGATGGTAAG

TTCTCCCGTGATAAGCTTAAAATTAGCAATAAGGATTGGTTCGACTTCATCCAGAACAAA

CGTTACCTG

SEQ ID NO: 30

ATGAACAACGGAACAAACAATTTCCAAAACTTCATCGGTATCTCTTCGTTGCAGAAGACT

CTGCGTAATGCTTTGATCCCGACGGAGACAACCCAACAATTTATCGTCAAAAACGGTATT

ATTAAGGAGGACGAGTTACGTGGAGAAAATCGTCAAATCCTTAAGGACATCATGGACGAT

TATTATCGCGGGTTTATTTCTGAAACCCTGAGCAGTATCGATGATATCGACTGGACCTCA

CTTTTTGAGAAAATGGAGATCCAGTTGAAGAACGGTGATAACAAAGACACTCTGATCAAA

-continued

GAGCAAACTGAATACCGCAAGGCAATTCACAAAAAGTTCGCCAACGACGACCGTTTCAAG

AATATGTTCTCAGCTAAGTTAATCAGCGACATTTTGCCAGAGTTCGTTATCCACAACAAT

AATTATAGTGCTTCAGAGAAGGAGGAAAAAACCCAAGTGATTAAACTTTTTTCGCGCTTT

GCAACCTCATTCAAGGACTACTTCAAGAATCGCGCGAATTGCTTCAGTGCGGACGACATT

TCTTCTTCAAGTTGCCATCGTATCGTTAACGATAACGCGGAAATTTTCTTCTCTAATGCT

TTGGTGTATCGCCGCATTGTAAAATCGCTTAGTAACGATGACATTAATAAGATCTCAGGT

GATATGAAAGATTCATTGAAGGAAATGAGCTTGGAAGAGATTTACAGTTACGAAAAATAT

GGAGAATTTATTACTCAGGAAGGCATCTCATTCTATAACGATATCTGCGGGAAGGTAAAT

TCGTTTATGAACTTATATTGCCAGAAAAATAAAGAGAATAAAAATTTGTATAAGCTTCAG

AAGTTGCACAAACAGATCCTGTGCATTGCAGACACCTCGTATGAGGTTCCGTATAAATTT

GAGTCCGATGAAGAAGTGTATCAGTCTGTGAATGGTTTCTTAGATAATATCTCTTCCAAG

CATATTGTCGAACGCCTGCGCAAAATTGGTGATAACTATAACGGATACAATCTGGATAAA

ATTTACATCGTTTCTAAATTTTACGAGTCAGTCTCGCAGAAGACCTACCGCGACTGGGAA

ACAATTAACACGGCATTGGAGATTCACTACAATAATATCTTGCCTGGTAACGGTAAGTCT

AAGGCAGATAAGGTAAAAAAAGCTGTGAAAAACGACCTTCAGAAAAGCATCACGGAGATT

AATGAGCTGGTGAGTAATTACAAATTATGTTCAGACGATAATATTAAAGCTGAAACGTAT

ATCCATGAAATCTCGCATATCTTGAACAACTTCGAGGCCCAAGAACTTAAATATAACCCC

GAAATCCATTTAGTCGAGTCTGAATTGAAAGCGTCGGAATTAAAAAACGTCTTAGACGTC

ATTATGAACGCGTTTCACTGGTGTTCAGTTTTCATGACCGAAGAGCTGGTCGACAAAGAC

AACAACTTCTATGCGGAATTGGAGGAAATCTATGATGAAATCTACCCTGTTATTTCACTG

TATAACCTTGTGCGCAACTATGTCACTCAGAAGCCGTATTCGACCAAAAAAATTAAATTG

AATTTCGGTATCCCTACTCTTGCAGACGGATGGAGTAAAAGCAAGGAATACAGTAATAAC

GCCATTATTCTTATGCGCGACAATTTATACTACCTGGGCATCTTTAACGCAAAGAATAAG

CCGGATAAGAAGATTATTGAGGGTAACACCAGTGAGAACAAGGGCGACTATAAGAAGATG

ATCTATAACTTATTGCCAGGTCCAAATAAAATGATCCCAAAAGTATTCTTATCATCAAAG

ACGGGAGTTGAAACCTATAAGCCTAGTGCCTATATTCTTGAGGGATATAAACAGAACAAG

CACATTAAGTCGTCTAAGGATTTTGACATTACGTTCTGCCATGACTTAATCGACTATTTT

AAAAACTGTATTGCGATTCACCCCGAATGGAAGAATTTTGGATTCGATTTTTCGGATACC

TCGACCTATGAAGATATTTCGGGATTTTATCGTGAAGTGGAGTTGCAAGGCTATAAAATC

GATTGGACCTATATCTCAGAAAAAGACATTGATTTATTACAGGAAAAGGGACAACTGTAC

CTTTTCCAAATTTATAACAAGGACTTTTCTAAAAAGTCCACAGGAAATGATAACCTTCAC

ACCATGTACCTGAAGAACCTTTTCTCAGAGGAAAACCTGAAGGACATTGTCCTTAAGTTA

AATGGAGAAGCGGAGATCTTTTTCCGTAAATCTAGTATCAAGAATCCGATTATCCATAAA

AAAGGTTCGATTTTGGTAAATCGCACCTATGAAGCGGAAGAGAAAGATCAATTTGGTAAC

ATCCAGATCGTGCGCAAGAATATCCCGGAGAACATTTACCAAGAGCTGTATAAGTACTTC

AATGATAAGTCTGATAAGGAACTGTCAGATGAAGCTGCGAAATTGAAGAACGTGGTTGGG

CATCATGAAGCCGCTACCAATATCGTCAAGGATTACCGTTATACCTATGACAAATATTTC

TTACACATGCCGATTACGATCAATTTTAAGGCAAACAAGACAGGATTCATCAACGACCGT

ATCTTGCAGTATATTGCCAAAGAGAAGGATCTGCATGTGATCGGTATTGACCGCGGGGAG

CGCAATTTAATCTATGTATCGGTGATCGATACTTGTGGTAACATCGTAGAACAAAAGAGC

-continued

TTTAACATCGTGAATGGTTACGACTATCAGATCAAGCTGAAACAACAGGAAGGAGCCCGC

CAGATCGCTCGCAAGGAATGGAAAGAAATCGGGAAAATTAAGGAAATCAAGGAAGGCTAC

CTTTCATTGGTCATTCACGAAATTTCGAAAATGGTAATTAAGTACAACGCGATCATCGCC

ATGGAGGACCTTTCGTACGGATTTAAGAAGGGTCGTTTCAAAGTTGAGCGCCAGGTATAC

CAAAAATTCGAGACTATGCTTATCAACAAACTTAACTACTTGGTCTTTAAGGACATTTCT

ATTACCGAAAACGGCGGCTTACTTAAAGGCTATCAATTGACATATATTCCCGACAAACTG

AAGAATGTTGGACATCAATGCGGGTGTATTTTCTATGTGCCGGCAGCTTACACTAGTAAG

ATCGACCCTACAACCGGGTTCGTAAACATTTTTAAATTCAAAGACTTAACAGTCGATGCG

AAGCGTGAATTTATTAAGAAGTTTGATAGTATCCGCTATGACAGTGAAAAGAACTTGTTT

TGCTTTACGTTCGACTACAATAACTTTATTACACAGAACACGGTCATGTCTAAATCATCA

TGGTCGGTTTACACATATGGGGTGCGCATCAAGCGTCGCTTTGTAAATGGCCGTTTTAGT

AATGAGAGCGACACAATCGACATCACAAAGGATATGGAGAAAACTCTTGAGATGACAGAC

ATCAATTGGCGTGACGGTCATGACTTACGCCAAGATATCATCGACTACGAAATCGTACAG

CATATTTTTGAGATTTTTCGTCTTACTGTGCAAATGCGTAATTCTTTATCCGAACTGGAA

GATCGTGATTACGACCGCTTGATTAGTCCCGTCTTAAATGAGAACAATATTTTCTATGAT

TCTGCGAAAGCCGGAGATGCACTGCCCAAAGACGCTGATGCCAATGGCGCGTATTGCATT

GCATTAAAAGGATTATATGAGATTAAACAGATTACCGAAAATTGGAAAGAGGACGGTAAA

TTCTCACGCGATAAATTGAAGATTTCTAACAAGGACTGGTTCGACTTTATCCAAAATAAA

CGTTATCTT

SEQ ID NO: 31

ATGAATAACGGTACCAACAACTTTCAGAATTTCATTGGCATTAGCTCGCTTCAAAAAACT

TTACGCAATGCTCTTATTCCGACTGAGACGACACAACAGTTTATCGTTAAGAATGGCATC

ATCAAAGAAGATGAATTACGCGGAGAAAACCGCCAGATCCTGAAAGACATTATGGACGAT

TATTACCGTGGGTTCATCTCCGAGACGTTGTCATCGATCGATGACATCGACTGGACGTCA

CTTTTTGAAAAAATGGAGATCCAGTTAAAGAACGGTGACAATAAGGATACATTGATCAAA

GAACAGACCGAGTACCGTAAAGCGATTCATAAAAAGTTTGCGAACGATGATCGCTTCAAG

AATATGTTTTCTGCGAAATTAATTTCCGACATTTTACCTGAATTTGTTATTCATAATAAC

AACTACTCGGCGTCTGAGAAAGAGGAGAAAACCCAAGTGATTAAACTTTTTTCACGTTTC

GCAACGTCGTTCAAAGACTATTTTAAAAATCGTGCTAATTGCTTTAGCGCGGATGACATC

AGCTCTAGTTCATGTCATCGCATTGTCAACGATAATGCTGAGATCTTTTTCAGTAATGCG

TTAGTGTACCGTCGTATTGTGAAGTCCTTATCTAATGATGATATCAATAAGATCAGCGGG

GATATGAAGGACTCACTTAAGGAGATGAGCTTGGAGGAAATCTATTCCTATGAGAAGTAT

GGTGAGTTTATTACGCAAGAAGGAATTAGCTTTTACAACGATATCTGTGGAAAGGTGAAT

TCGTTTATGAATTTGTATTGCCAGAAAAATAAGGAGAACAAGAACCTTTATAAATTGCAA

AAGTTACACAAGCAAATCCTGTGCATTGCAGATACTTCCTACGAGGTGCCTTACAAGTTT

GAATCCGACGAAGAGGTCTACCAATCTGTAAACGGTTTCTTAGATAATATTAGTTCCAAG

CATATTGTGGAGCGCCTTCGTAAAATTGGCGATAATTACAACGGTTACAATTTAGACAAA

ATTTACATTGTCAGTAAATTCTACGAGTCCGTATCTCAAAAGACGTATCGTGATTGGGAG

ACTATCAATACGGCCCTGGAGATCCACTACAACAATATCTTGCCCGGTAATGGTAAGTCG

AAGGCCGATAAAGTTAAGAAAGCGGTGAAAAATGACTTACAGAAGTCAATCACCGAAATT

AACGAATTGGTGTCCAATTATAAATTGTGTTCAGATGATAATATCAAAGCCGAGACCTAC

-continued

ATTCATGAGATTTCCCATATCTTAAATAATTTCGAGGCGCAAGAGCTTAAGTATAACCCA

GAAATCCACCTGGTAGAATCTGAGTTGAAGGCGTCAGAGTTAAAAAATGTTTTAGATGTC

ATTATGAACGCGTTTCACTGGTGCTCCGTATTTATGACGGAGGAATTAGTAGATAAAGAC

AACAATTTCTATGCCGAACTTGAGGAAATCTATGATGAGATCTATCCCGTCATTAGCCTG

TATAACTTGGTCCGCAACTATGTTACCCAAAAACCGTACAGTACCAAGAAGATTAAGCTG

AATTTCGGCATTCCTACACTGGCTGATGGTTGGAGTAAATCGAAGGAATATTCGAATAAC

GCGATTATCTTGATGCGCGACAACTTATACTATTTGGGGATCTTTAACGCCAAAAACAAA

CCGGATAAGAAGATTATTGAGGGAAACACATCAGAGAACAAAGGCGACTACAAAAAAATG

ATTTACAACTTGTTACCGGGGCCTAACAAAATGATCCCGAAGGTGTTCTTATCCAGTAAA

ACAGGCGTTGAGACCTACAAACCTTCCGCATACATCCTGGAAGGGTATAAGCAGAACAAG

CACATTAAGTCCAGCAAGGATTTCGATATTACCTTCTGTCATGATTTAATTGACTATTTC

AAGAACTGTATTGCAATCCACCCCGAGTGGAAGAACTTCGGATTCGACTTCTCAGATACG

AGCACATATGAGGACATCTCGGGGTTCTATCGTGAAGTAGAACTGCAGGGATATAAAATT

GATTGGACATATATTTCCGAAAAAGACATCGACCTTTTACAAGAGAAGGGTCAACTTTAC

TTGTTCCAAATTTACAATAAAGACTTCTCAAAAAAAAGCACGGGTAACGATAATTTACAC

ACTATGTATTTAAAGAACCTTTTCTCGGAAGAGAATTTAAAGGATATCGTATTGAAGTTG

AATGGAGAAGCGGAGATCTTCTTCCGTAAGTCCAGTATTAAAAACCCTATTATTCACAAG

AAGGGATCGATTTTAGTTAACCGCACATACGAGGCCGAAGAGAAGGACCAATTTGGGAAC

ATTCAAATTGTCCGCAAAAACATCCCTGAGAACATTTATCAAGAGCTTTATAAGTACTTT

AACGATAAGTCCGATAAGGAATTGTCAGATGAGGCGGCAAAGTTGAAGAATGTCGTGGGG

CATCATGAAGCTGCCACCAACATTGTGAAGGACTACCGCTACACTTACGACAAATACTTC

CTGCACATGCCCATTACGATCAATTTTAAGGCCAATAAGACAGGCTTTATTAACGACCGT

ATTCTTCAATATATCGCTAAGGAGAAGGACCTTCATGTGATTGGGATCGACCGCGGAGAA

CGTAATTTAATTTATGTGTCCGTCATCGATACGTGTGGAAATATCGTGGAACAGAAATCA

TTCAATATCGTGAATGGCTATGATTACCAGATCAAATTAAAACAGCAGGAGGGCGCTCGC

CAAATTGCGCGTAAGGAATGGAAAGAGATCGGAAAAATCAAAGAAATCAAAGAAGGATAT

TTGTCATTGGTGATCCATGAGATTTCAAAAATGGTAATTAAATATAATGCAATTATCGCA

ATGGAAGACCTGTCCTATGGTTTTAAGAAGGGTCGTTTCAAGGTAGAACGCCAAGTGTAT

CAAAAGTTCGAGACGATGCTGATCAATAAGCTGAATTATCTTGTGTTTAAGGACATTAGC

ATCACGGAAAATGGAGGGCTGTTGAAAGGCTATCAACTGACGTATATCCCTGACAAGCTG

AAAAATGTTGGCCATCAGTGCGGGTGCATTTTCTACGTCCCCGCGGCGTATACAAGCAAG

ATCGATCCTACTACGGGATTCGTAAATATTTTTAAATTCAAAGACTTAACCGTGGACGCC

AAGCGCGAATTCATTAAGAAGTTTGATAGCATTCGCTACGATTCAGAAAAAAATCTTTTC

TGTTTTACGTTCGATTACAACAATTTTATCACCCAGAACACAGTGATGAGCAAGTCATCC

TGGTCTGTCTATACCTACGGTGTCCGTATCAAACGCCGCTTCGTCAACGGACGCTTCTCT

AATGAATCTGATACCATTGACATCACCAAGGACATGGAAAAGACACTTGAGATGACAGAT

ATTAACTGGCGTGACGGACATGACCTGCGTCAGGACATCATCGATTATGAGATTGTTCAG

CATATCTTCGAGATCTTCCGCCTGACAGTACAAATGCGCAATTCACTGTCAGAACTTGAA

GACCGCGACTATGACCGCCTGATCTCTCCAGTATTAAATGAGAACAATATCTTTTATGAC

AGTGCTAAGGCCGGCGATGCCCTTCCGAAAGATGCTGATGCTAACGGAGCTTATTGTATT

-continued

GCATTAAAGGGTCTTTATGAGATCAAGCAAATTACCGAGAATTGGAAGGAGGATGGCAAA

TTCTCGCGCGACAAACTGAAAATCAGTAACAAGGACTGGTTCGATTTTATTCAGAATAAA

CGTTACCTG

SEQ ID NO: 32

ATGAATAACGGAACGAACAACTTCCAGAACTTCATCGGCATCAGTTCTTTACAAAAAACC

CTGCGTAACGCCCTTATTCCGACTGAGACAACACAACAGTTCATCGTTAAAAACGGAATT

ATCAAAGAGGACGAGTTGCGCGGCGAGAATCGCCAAATTTTGAAAGATATTATGGACGAC

TATTATCGTGGTTTTATTTCAGAAACACTGAGTTCGATTGACGATATCGATTGGACGAGC

CTGTTTGAGAAAATGGAAATCCAGTTGAAAAATGGCGATAATAAAGACACTTTAATCAAA

GAACAAACCGAGTATCGTAAAGCGATCCATAAAAAGTTCGCTAATGACGATCGTTTTAAG

AATATGTTCAGTGCGAAACTGATTTCAGACATTTTGCCCGAGTTCGTGATCCATAATAAC

AACTATTCCGCCTCGGAAAAGGAAGAAAAAACCCAGGTGATTAAGCTGTTCAGTCGCTTC

GCAACATCTTTCAAGGATTATTTCAAGAATCGCGCGAATTGCTTCAGTGCGGACGATATT

TCTAGTTCAAGCTGCCATCGTATCGTTAATGATAACGCGGAGATTTTTTTTAGCAATGCT

CTGGTGTACCGCCGCATTGTTAAGTCACTGTCCAACGATGATATTAACAAGATCTCAGGA

GACATGAAAGACTCGCTTAAAGAGATGAGTCTGGAAGAGATCTATTCTTATGAGAAGTAT

GGCGAGTTTATTACCCAAGAAGGAATCTCATTCTACAATGATATTTGTGGAAAGGTGAAC

AGCTTTATGAATCTTTACTGCCAAAAAAACAAGGAGAATAAGAATCTTTACAAACTTCAG

AAGTTACATAAACAGATTTTGTGTATTGCGGATACGTCTTATGAAGTCCCCTACAAATTT

GAATCGGATGAAGAGGTATACCAAAGTGTGAACGGATTCTTGGACAATATTTCTTCTAAA

CATATTGTTGAACGCTTACGTAAGATCGGGGATAACTACAATGGCTACAATCTTGACAAA

ATCTACATTGTTAGCAAATTCTACGAGAGTGTCAGCCAAAAGACGTACCGCGATTGGGAA

ACAATTAATACTGCGCTTGAGATTCACTATAATAACATTTTACCAGGCAACGGCAAGTCC

AAGGCGGATAAAGTTAAAAAAGCTGTTAAAAACGATTTGCAAAAATCTATCACAGAAATT

AACGAGTTAGTTAGTAACTACAAACTGTGCTCCGATGACAACATTAAGGCTGAGACGTAT

ATCCATGAGATCTCTCACATCTTAAACAATTTTGAAGCTCAAGAACTTAAGTACAATCCG

GAAATCCACCTGGTGGAATCCGAGCTGAAGGCTAGCGAACTGAAGAACGTATTGGACGTG

ATCATGAACGCGTTCCACTGGTGTTCTGTCTTTATGACGGAAGAGCTTGTCGACAAAGAT

AATAACTTTTACGCGGAACTTGAGGAAATTTACGATGAGATTTACCCAGTTATTTCATTG

TATAACCTTGTCCGTAATTACGTGACCCAAAAGCCTTATAGTACGAAAAAAATCAAATTA

AATTTTGGAATCCCAACACTGGCTGACGGTTGGAGCAAATCTAAGGAGTATTCTAATAAC

GCAATCATCTTAATGCGTGACAACCTGTATTATTTGGGTATCTTCAATGCCAAAAATAAG

CCTGACAAAAAGATTATCGAAGGAAATACTTCGGAGAATAAGGGGGATTACAAAAAAATG

ATTTACAATTTGCTGCCCGGGCCGAACAAGATGATCCCCAAAGTGTTCTTATCCTCGAAG

ACTGGTGTAGAAACATACAAGCCAAGCGCATACATTCTGGAGGGTTACAAGCAAAACAAA

CACATCAAATCTTCAAAAGACTTTGACATTACATTTTGCCATGATCTTATTGACTACTTC

AAAAACTGCATTGCTATTCACCCCGAGTGGAAGAACTTTGGGTTTGACTTCAGCGACACG

TCTACGTATGAGGACATCTCCGGGTTCTACCGTGAAGTTGAGTTACAAGGGTATAAGATT

GACTGGACGTATATTTCAGAGAAAGATATCGATCTTTTGCAGGAAAAGGGCCAGTTATAT

TTATTCCAGATTTACAACAAGGACTTTAGTAAGAAGTCAACAGGAAATGACAACTTGCAT

ACGATGTATTTGAAAAATCTTTTTTCTGAGGAAAATCTTAAGGACATCGTACTGAAATTG

-continued

AATGGCGAGGCTGAAATCTTCTTCCGTAAATCCTCCATTAAGAATCCCATTATCCACAAA

AAGGGGTCTATCCTGGTGAATCGTACCTACGAGGCAGAGGAGAAGGATCAATTCGGAAAT

ATTCAGATTGTTCGTAAGAACATCCCCGAGAACATTTATCAAGAATTGTATAAGTACTTT

AATGACAAATCTGACAAAGAGTTATCCGACGAAGCTGCGAAACTGAAAAACGTTGTTGGT

CACCACGAGGCCGCCACTAATATCGTAAAAGACTACCGTTATACCTATGACAAGTACTTT

TTGCACATGCCGATCACTATCAACTTCAAGGCGAATAAGACGGGCTTCATTAACGATCGT

ATCCTGCAATACATCGCCAAGGAGAAGGACCTTCACGTCATTGGGATTGACCGTGGTGAG

CGTAACCTGATTTATGTAAGCGTCATTGATACCTGCGGTAATATCGTCGAACAGAAAAGT

TTCAACATTGTAAATGGATATGACTATCAGATCAAACTTAAGCAGCAGGAGGGTGCACGC

CAGATTGCCCGCAAGGAATGGAAGGAGATTGGGAAGATTAAGGAAATTAAAGAAGGTTAC

TTATCACTGGTTATTCACGAGATCAGTAAAATGGTAATCAAATATAACGCGATCATTGCC

ATGGAGGATCTGAGCTATGGCTTTAAAAAGGGCCGTTTCAAAGTCGAGCGCCAGGTATAT

CAAAAGTTTGAAACAATGCTGATTAACAAATTAAACTATCTGGTTTTCAAAGATATTTCG

ATCACTGAAAATGGCGGGCTGTTGAAGGGATACCAACTTACATACATCCCTGACAAACTG

AAAAATGTCGGTCACCAATGTGGATGTATCTTTTATGTACCAGCAGCGTATACGAGCAAA

ATCGATCCAACTACGGGTTTTGTGAACATCTTTAAGTTCAAGGATTTGACAGTAGATGCC

AAACGCGAGTTCATTAAAAAATTTGATTCAATTCGCTACGATTCAGAGAAAAATCTTTTT

TGTTTCACGTTCGATTACAATAATTTCATTACGCAGAACACAGTAATGTCAAAGTCAAGC

TGGTCGGTCTACACGTATGGAGTCCGTATTAAACGTCGTTTTGTAAACGGCCGTTTCTCA

AATGAATCAGATACAATTGATATTACGAAGGATATGGAGAAGACATTAGAGATGACTGAC

ATTAACTGGCGCGACGGACATGATCTTCGTCAGGACATTATTGATTATGAGATTGTACAG

CATATCTTTGAGATCTTCCGCCTGACCGTTCAGATGCGCAATTCGTTGTCCGAGTTAGAA

GACCGCGATTACGACCGTTTAATCAGTCCCGTCTTAAACGAAAATAACATCTTCTACGAT

TCAGCCAAGGCAGGCGATGCCTTGCCAAAGGATGCTGACGCAAATGGCGCATACTGTATT

GCGTTGAAAGGCCTTTATGAAATCAAGCAAATTACCGAAAACTGGAAAGAAGACGGAAAA

TTCTCCCGTGATAAGTTGAAAATCTCTAATAAGGATTGGTTCGATTTCATCCAAAATAAA

CGCTATTTG

SEQ ID NO: 33

ATGAACAACGGAACTAATAATTTCCAAAATTTTATAGGCATCTCTTCTTTACAGAAGACT

CTTCGTAACGCCCTAATCCCGACTGAGACCACACAACAATTCATAGTGAAAAATGGGATC

ATTAAAGAAGACGAGCTGCGTGGGGAGAACAGGCAGATCCTAAAAGACATAATGGACGAT

TATTATAGAGGGTTCATCTCAGAGACATTATCTAGCATCGACGACATTGACTGGACCTCC

CTGTTTGAAAAAATGGAAATCCAGCTGAAGAATGGTGACAATAAAGACACATTAATAAAA

GAACAAACAGAGTACAGGAAAGCCATCCACAAGAAGTTCGCAAACGATGACAGATTCAAA

AATATGTTCAGTGCGAAGCTAATATCCGACATCTTACCAGAGTTTGTAATACACAATAAC

AATTACAGCGCGAGCGAAAAGGAAGAGAAAACGCAAGTAATTAAGCTTTTTAGTAGGTTC

GCTACCTCTTTCAAAGATTACTTCAAAAATCGTGCTAACTGCTTCTCAGCCGACGACATA

TCTTCAAGTTCCTGTCACCGTATCGTGAATGATAACGCTGAGATATTCTTCTCAAACGCC

CTTGTATACCGTAGGATCGTAAAGTCCTTATCTAACGATGATATAAACAAGATCAGTGGA

GACATGAAAGACAGCCTTAAAGAGATGTCTCTAGAAGAAATTTACTCCTATGAAAAGTAT

GGGGAGTTTATAACACAGGAGGGGATCAGCTTCTACAACGACATCTGCGGAAAGGTGAAC

-continued

AGTTTCATGAATCTTTACTGCCAGAAGAATAAAGAGAACAAAAATCTTTATAAGCTTCAA

AAGTTGCACAAACAAATACTGTGCATTGCCGATACATCATATGAGGTCCCCTATAAGTTC

GAATCTGATGAGGAAGTTTATCAATCTGTTAACGGCTTTCTAGACAATATCAGCTCAAAA

CACATCGTAGAAAGACTGAGGAAAATAGGTGATAATTATAATGGATACAACTTGGATAAA

ATATATATAGTCTCTAAATTTTACGAGTCAGTATCCCAGAAAACGTATAGGGATTGGGAG

ACCATCAACACGGCGTTAGAGATTCATTACAATAACATCTTACCGGGAAACGGAAAAAGT

AAGGCGGACAAAGTAAAGAAAGCCGTTAAAAATGACTTACAAAAGAGTATAACAGAAATA

AACGAACTAGTAAGCAACTACAAGCTTTGTTCCGATGATAATATCAAGGCCGAGACATAT

ATCCATGAGATCTCCCACATTCTAAACAATTTCGAAGCGCAAGAACTTAAATATAATCCC

GAAATCCACCTGGTGGAAAGTGAACTAAAGGCTAGTGAGTTAAAGAACGTTCTTGATGTT

ATCATGAACGCCTTCCATTGGTGCTCTGTTTTTATGACCGAGGAGTTGGTTGATAAAGAT

AATAATTTCTACGCTGAATTAGAGGAGATATACGACGAAATCTACCCAGTGATTTCACTA

TACAACTTGGTCAGGAACTATGTTACACAAAAGCCGTACAGCACTAAGAAAATTAAGCTA

AATTTCGGTATCCCCACGTTAGCCGACGGGTGGAGCAAGTCCAAAGAATATTCCAACAAT

GCGATTATTTTAATGCGTGACAATCTTTATTACCTTGGCATCTTCAATGCCAAAAACAAA

CCTGACAAAAAGATTATAGAAGGTAATACGTCCGAGAACAAAGGCGATTACAAGAAGATG

ATTTATAACCTACTGCCCGGACCAAACAAAATGATCCCCAAAGTTTTTCTTAGTTCTAAA

ACCGGCGTAGAGACGTATAAACCTTCTGCCTATATCTTAGAGGGATATAAGCAGAACAAA

CATATCAAATCTTCCAAGGACTTTGATATTACATTCTGCCACGATTTAATTGACTACTTC

AAAAATTGCATAGCGATACATCCGGAGTGGAAGAACTTTGGCTTCGACTTCAGTGATACA

TCCACCTATGAGGATATATCAGGCTTCTATCGTGAGGTCGAATTGCAAGGGTACAAAATC

GATTGGACGTATATATCCGAGAAAGACATAGACCTTCTTCAAGAAAAGGGGCAGTTATAT

TTATTCCAAATATACAACAAGGACTTCAGTAAGAAGTCAACAGGTAATGACAACTTACAC

ACCATGTACTTGAAAAATTTATTTTCTGAAGAAAACCTAAAGGACATTGTACTAAAACTG

AACGGGGAGGCAGAAATTTTTTTAGAAAGAGCAGCATAAAAAACCCAATAATTCATAAG

AAAGGAAGCATTTTAGTTAATAGGACGTACGAGGCAGAGGAAAAGGACCAGTTTGGCAAT

ATCCAGATCGTAAGGAAAAATATTCCTGAAAACATATATCAGGAACTATATAAATACTTT

AACGACAAATCCGACAAAGAATTATCCGACGAGGCTGCAAAGCTGAAGAACGTCGTAGGG

CACCATGAGGCAGCGACTAATATTGTGAAAGACTATAGGTATACATACGACAAATACTTT

CTGCACATGCCCATCACGATTAACTTCAAGGCGAACAAGACGGGATTCATTAACGACCGT

ATATTACAATATATTGCTAAGGAGAAAGATCTGCATGTAATAGGTATCGACAGAGGCGAA

CGTAATTTAATCTACGTGTCCGTCATCGACACGTGCGGGAACATCGTAGAGCAAAAGAGT

TTTAATATAGTAAATGGCTATGATTACCAAATTAAGCTAAAGCAGCAAGAAGGAGCAAGA

CAGATAGCTAGGAAAGAATGGAAGGAGATAGGAAAAATAAAGGAGATCAAGGAGGGGTAT

CTTAGCCTAGTAATTCATGAAATATCTAAGATGGTTATCAAATACAACGCTATCATAGCG

ATGGAAGACTTATCTTATGGTTTCAAGAAAGGAAGGTTCAAAGTAGAGCGTCAAGTTTAT

CAAAAGTTCGAAACGATGTTGATTAATAAACTAAACTATTTGGTATTTAAAGATATATCT

ATCACCGAGAATGGTGGTCTACTAAAGGGTTACCAGCTTACATACATACCGGACAAACTT

AAAAACGTCGGACATCAGTGTGGATGCATTTTCTACGTTCCAGCTGCATATACCAGCAAG

ATCGACCCAACGACTGGGTTCGTAAATATTTTTAAATTCAAGGATTTGACTGTCGACGCC

AAAAGAGAGTTCATAAAAAAGTTCGATTCAATTAGGTACGACAGCGAAAAGAATTTGTTC

-continued

TGCTTTACTTTTGACTATAACAATTTCATTACTCAGAACACTGTAATGTCTAAGTCCTCT

TGGTCAGTCTATACTTATGGCGTTCGTATCAAACGTAGATTTGTTAACGGTAGATTCTCA

AATGAAAGTGATACAATAGATATCACGAAAGATATGGAGAAAACATTAGAAATGACAGAC

ATAAACTGGAGAGACGGACATGACTTGAGACAGGACATTATTGACTACGAGATCGTGCAG

CACATCTTTGAGATCTTTCGTTTGACCGTACAAATGCGTAACAGTTTATCTGAGCTTGAG

GACAGGGACTACGATAGATTGATATCACCTGTATTAAATGAGAATAACATCTTCTATGAT

TCCGCAAAAGCAGGCGACGCTCTACCCAAAGACGCTGATGCGAACGGTGCTTATTGCATA

GCTTTAAAGGGTTTGTATGAGATCAAACAGATAACAGAAAATTGGAAGGAAGATGGTAAG

TTCTCCCGTGACAAGCTTAAAATATCAAATAAGGACTGGTTCGATTTTATACAGAATAAG

CGTTATTA

SEQ ID NO: 34

ATGAACAATGGAACTAATAACTTCCAGAATTTCATTGGTATCTCCTCTTTACAAAAAACT

CTAAGAAACGCCCTAATTCCGACTGAAACTACACAGCAATTCATCGTCAAAAACGGGATC

ATTAAGGAGGATGAGTTGAGGGGTGAAAATCGTCAAATTCTTAAAGACATCATGGACGAC

TACTACAGGGGGTTCATCAGCGAGACGTTATCTAGTATAGACGATATAGACTGGACTTCA

CTGTTCGAGAAGATGGAAATCCAATTAAAAAATGGGGACAATAAAGATACACTTATAAAG

GAACAGACAGAGTATAGAAAGGCAATACACAAAAAGTTTGCCAACGACGATCGTTTCAAG

AACATGTTTAGTGCTAAATTGATTTCAGATATTCTGCCGGAATTTGTTATTCACAACAAT

AATTATAGCGCCAGTGAGAAAGAAGAAAAAACGCAGGTTATCAAACTGTTCAGTCGTTTC

GCTACATCTTTTAAGGATTACTTTAAAAACCGTGCAAATTGTTTTTCAGCCGACGATATT

AGTAGCAGCTCTTGTCACCGTATTGTTAATGATAATGCGGAGATTTTCTTTTCAAACGCA

TTGGTCTACAGGAGGATAGTCAAGTCCCTTTCAAATGACGACATTAATAAGATCTCAGGT

GACATGAAAGATTCCTTAAAGGAAATGTCCCTGGAAGAGATCTATTCCTATGAAAAGTAC

GGTGAGTTCATTACTCAAGAGGGTATAAGCTTTTACAATGACATATGTGGTAAGGTTAAT

AGCTTTATGAACCTGTATTGCCAGAAGAACAAAGAAAATAAGAATCTGTATAAGTTGCAA

AAGCTACACAAACAAATTTTGTGCATTGCCGATACATCATACGAGGTGCCATACAAATTC

GAGAGCGATGAGGAGGTTTATCAGAGCGTGAATGGATTCCTGGACAATATTAGTAGTAAG

CATATCGTGGAAAGGCTTAGAAAGATAGGTGACAATTACAATGGCTACAATCTGGATAAA

ATCTACATCGTCTCAAAATTCTATGAAAGTGTATCCCAGAAGACGTACCGTGATTGGGAA

ACTATCAACACCGCTCTGGAGATACATTACAACAATATACTTCCCGGAAACGGCAAGTCA

AAAGCCGACAAAGTCAAAAAAGCGGTCAAGAACGATTTACAAAAGTCTATCACTGAAATT

AATGAATTAGTTAGTAATTACAAACTGTGTAGTGATGATAATATTAAGGCAGAGACTTAC

ATACACGAAATTTCACACATTTTAAACAACTTCGAGGCACAGGAACTTAAATATAATCCT

GAAATTCACCTGGTTGAAAGTGAATTGAAAGCCAGCGAGCTAAAGAACGTTTTGGACGTA

ATCATGAACGCATTCCACTGGTGCTCTGTCTTTATGACAGAGGAACTAGTGGATAAGGAC

AATAATTTTTATGCGGAGCTGGAGGAAATATACGATGAGATATATCCCGTAATATCATTA

TATAATCTGGTAAGAAACTATGTGACTCAAAAGCCGTATAGCACCAAGAAAATTAAACTT

AATTTCGGCATACCCACTTTAGCGGACGGCTGGTCAAAATCCAAAGAGTATAGTAATAAT

GCCATCATCCTGATGCGTGACAACCTGTACTATTTAGGTATATTTAACGCCAAAAAATAAA

CCCGACAAAAAGATTATAGAGGGCAACACCTCAGAGAACAAAGGTGATTATAAGAAGATG

ATTTACAACCTTTTACCCGGTCCTAATAAGATGATTCCCAAAGTCTTTCTATCTAGCAAA

-continued

ACTGGTGTTGAAACATACAAACCCTCAGCTTATATTTTAGAAGGGTATAAGCAGAATAAG

CATATTAAAAGCTCCAAAGATTTCGATATTACCTTTTGCCATGACTTGATAGACTATTTC

AAAAATTGTATTGCCATTCACCCTGAATGGAAAAACTTCGGATTTGACTTCTCTGACACA

TCCACCTACGAAGACATTTCAGGTTTTTACAGGGAAGTCGAGCTACAGGGTTATAAAATT

GATTGGACATACATCAGCGAGAAAGATATTGACCTACTTCAAGAAAAAGGGCAGCTATAC

CTGTTCCAGATATACAATAAAGACTTCAGTAAAAAAAGCACCGGGAACGATAATCTTCAC

ACAATGTACTTAAAAAATTTATTTAGTGAAGAGAATCTGAAGGATATAGTGCTGAAGTTA

AACGGGGAGGCAGAGATATTTTTTAGAAAATCTAGTATTAAGAATCCGATCATCCACAAG

AAGGGTTCTATCCTTGTTAATAGGACTTATGAGGCAGAAGAAAAAGACCAATTCGGCAAC

ATACAAATTGTCCGTAAAAATATCCCTGAGAACATTTATCAGGAACTATACAAGTACTTC

AATGATAAAAGCGACAAGGAGCTGAGCGACGAGGCTGCTAAGTTAAAGAATGTGGTGGGC

CACCATGAGGCAGCAACGAATATTGTGAAGGACTATCGTTATACCTACGATAAATACTTT

CTTCATATGCCGATCACCATTAATTTCAAGGCAAACAAAACTGGCTTCATTAACGATCGT

ATCTTACAATATATCGCAAAAGAGAAAGACCTTCACGTTATCGGGATCGATAGAGGCGAG

CGTAACCTAATTTATGTTTCTGTGATAGACACCTGTGGGAACATAGTCGAACAGAAATCA

TTTAATATTGTTAACGGCTACGATTATCAGATAAAGTTGAAGCAACAAGAGGGTGCACGT

CAAATAGCAAGGAAAGAATGGAAAGAAATAGGCAAGATTAAAGAAATAAAAGAAGGTTAT

TTATCCCTTGTAATACACGAAATTAGCAAAATGGTGATTAAATATAATGCGATCATTGCC

ATGGAGGATCTTTCTTACGGCTTCAAAAAGGGGAGATTCAAAGTCGAGAGGCAGGTGTAT

CAGAAGTTTGAGACCATGCTAATCAATAAACTAAATTATCTAGTATTCAAAGACATAAGC

ATCACCGAAAATGGCGGCTTGTTGAAGGGTTATCAATTGACCTACATCCCAGATAAACTA

AAAAACGTAGGGCATCAATGCGGATGTATATTTTACGTTCCAGCCGCATACACTTCCAAA

ATCGATCCAACTACGGGTTTTGTGAACATCTTCAAATTCAAAGACTTGACTGTCGATGCT

AAGAGGGAGTTTATCAAGAAATTTGACTCCATTAGATACGACAGTGAGAAGAATCTGTTC

TGTTTTACCTTTGATTATAACAACTTTATAACTCAAAACACAGTCATGAGTAAGTCATCT

TGGTCAGTGTATACGTATGGTGTGAGGATTAAAAGGAGGTTTGTTAACGGGAGATTTTCC

AATGAAAGTGATACAATAGATATAACCAAGGACATGGAAAAGACTCTTGAAATGACCGAC

ATTAACTGGAGAGATGGCCACGACTTACGTCAAGATATAATCGATTACGAGATAGTGCAA

CATATCTTTGAGATATTTAGGCTTACTGTCCAAATGCGTAACTCATTAAGTGAGTTGGAG

GACAGGGATTACGATAGGCTAATAAGTCCTGTTCTTAACGAAAACAATATATTCTACGAT

TCAGCAAAGGCGGGAGACGCCCTGCCCAAGGACGCGGATGCTAACGGCGCATACTGTATT

GCCCTGAAAGGCTTGTACGAGATAAAACAGATCACGGAGAACTGGAAAGAAGATGGAAAA

TTCAGTCGTGACAAGTTAAAAATTAGTAACAAAGACTGGTTCGACTTTATTCAGAACAAG

AGATATCTG

SEQ ID NO: 35

ATGAACAACGGAACCAATAACTTTCAAAACTTTATAGGCATCTCCAGTCTACAGAAGACA

CTACGTAACGCTTTGATACCAACTGAGACCACGCAGCAGTTTATCGTCAAGAACGGTATT

ATAAAGGAAGACGAGCTAAGGGGGGAAAACCGTCAGATCTTAAAGGACATCATGGATGAC

TACTACAGAGGCTTCATAAGTGAGACTTTGTCTAGTATAGACGACATCGACTGGACCAGT

TTATTTGAGAAGATGGAAATTCAGTTAAAGAACGGGGACAATAAAGACACACTAATTAAA

GAGCAGACCGAATACAGAAAAGCTATACACAAAAAGTTTGCCAACGATGATAGATTCAAA

-continued

AATATGTTTTCAGCAAAATTGATTTCCGACATATTGCCAGAATTCGTAATCCATAATAAC

AATTATTCTGCAAGTGAGAAGGAAGAGAAGACCCAAGTAATCAAGCTGTTTTCCCGTTTT

GCTACGAGTTTCAAAGATTATTTCAAGAATAGGGCTAATTGTTTCTCCGCGGACGACATA

AGTAGCAGTTCCTGTCACAGGATTGTGAACGATAATGCTGAGATATTTTTTTCCAATGCC

CTAGTGTATAGGAGAATAGTTAAAAGCTTAAGCAACGACGATATCAATAAAATTTCAGGG

GACATGAAGGACAGCTTAAAGGAAATGAGTTTGGAGGAGATTTACAGTTATGAAAAATAC

GGAGAGTTTATAACTCAGGAAGGCATCTCTTTCTATAATGATATCTGTGGGAAGGTAAAC

TCCTTCATGAATTTATATTGCCAGAAGAATAAGGAAAACAAAAATCTTTACAAGCTTCAA

AAGTTACATAAGCAGATCTTATGTATTGCCGACACGAGTTATGAAGTGCCTTATAAATTC

GAGAGTGATGAGGAAGTGTATCAGTCTGTTAACGGATTCCTAGATAATATAAGTTCCAAA

CATATAGTCGAGAGGCTGAGGAAGATTGGCGATAACTATAATGGATATAATCTTGACAAA

ATCTATATAGTCTCTAAATTTTATGAAAGCGTCAGCCAGAAGACATATAGAGATTGGGAA

ACTATAAACACAGCCCTTGAAATACATTACAATAACATCCTACCCGGCAATGGTAAGTCT

AAGGCAGACAAAGTTAAAAAAGCAGTAAAGAATGACTTACAGAAGTCAATCACGGAGATA

AATGAGTTGGTCAGTAACTACAAATTATGCTCCGACGATAATATTAAGGCCGAAACATAT

ATACACGAGATAAGTCATATATTAAACAATTTCGAAGCCCAGGAGTTAAAATATAACCCT

GAAATTCATCTGGTCGAAAGTGAGTTAAAGGCCAGTGAGTTAAAGAATGTACTTGACGTA

ATTATGAATGCTTTTCATTGGTGCTCCGTGTTCATGACCGAGGAGTTAGTAGATAAAGAC

AATAACTTTTACGCCGAACTTGAAGAGATATACGACGAGATTTATCCGGTAATCAGCTTG

TACAACTTAGTTAGAAATTATGTAACACAGAAGCCTTACTCTACTAAAAAAATAAAACTG

AACTTTGGTATCCCAACTCTTGCAGATGGTTGGAGTAAAAGCAAGGAATATAGCAACAAT

GCGATCATCTTGATGAGAGACAACTTGTACTATTTGGGAATCTTCAACGCGAAAAAATAAA

CCCGACAAAAAAATCATCGAAGGGAATACCTCTGAGAATAAAGGTGACTATAAGAAAATG

ATTTACAATCTACTTCCTGGTCCTAATAAAATGATCCCGAAAGTGTTTCTTAGTTCTAAG

ACTGGTGTCGAGACGTACAAACCTAGCGCGTACATCTTAGAAGGGTACAAGCAGAATAAA

CACATCAAATCAAGCAAAGACTTCGATATTACTTTTTGCCATGACTTGATAGACTACTTT

AAAAACTGCATAGCAATCCACCCGGAGTGGAAAAACTTTGGCTTTGATTTCTCTGACACC

TCTACATATGAGGACATATCTGGTTTTTACCGTGAGGTTGAATTGCAGGGATACAAAATT

GACTGGACTTACATATCTGAAAAAGATATCGATCTATTGCAGGAGAAAGGCCAGCTTTAC

CTTTTCCAGATCTATAATAAGGACTTCTCTAAGAAGTCTACAGGGAATGATAATTTGCAC

ACTATGTACTTAAAAAATCTGTTTTCCGAGGAAAACTTGAAAGACATTGTTTTAAAGTTG

AACGGAGAAGCTGAAATATTTTTCAGAAAGAGCTCCATAAAAAACCCGATCATTCATAAG

AAGGGATCTATCCTGGTTAACAGAACGTACGAAGCGGAAGAAAAAGACCAATTCGGAAAC

ATTCAAATTGTTAGAAAGAATATCCCTGAGAACATCTACCAGGAGTTATATAAGTATTTT

AATGATAAGTCAGATAAGGAACTATCTGACGAAGCGGCGAAGCTTAAAAATGTTGTAGGA

CACCATGAGGCTGCTACAAATATAGTCAAGGACTACCGTTATACCTACGATAAGTACTTT

CTACACATGCCCATTACCATCAATTTTAAAGCTAATAAAACGGGTTTTATCAACGATCGT

ATCCTACAATATATTGCGAAAGAGAAGGATTTGCATGTCATTGGCATTGATAGAGGTGAG

AGGAACCTAATATACGTATCCGTGATTGATACGTGCGGGAACATAGTTGAACAGAAATCA

TTTAATATAGTTAATGGGTACGACTATCAGATTAAGCTAAAGCAACAAGAAGGCGCCAGG

CAAATTGCCCGTAAAGAATGGAAAGAGATCGGGAAGATCAAGGAAATAAAAGAAGGATAC

CTTTCCCTGGTCATCCATGAAATTAGCAAAATGGTGATTAAGTACAATGCCATAATCGCG

ATGGAGGACTTAAGCTACGGGTTCAAAAAGGGGAGGTTTAAGGTGGAGAGGCAAGTGTAC

CAGAAATTTGAGACCATGCTAATCAACAAACTGAACTACCTAGTTTTTAAGGACATTTCA

ATTACAGAGAATGGAGGACTTTTAAAGGGTTACCAACTAACGTATATACCAGATAAGTTG

AAAAATGTCGGTCACCAGTGTGGCTGCATCTTTTACGTTCCCGCCGCTTATACATCTAAA

ATTGATCCAACCACAGGCTTTGTAAATATCTTTAAATTCAAAGATTTAACTGTGGATGCA

AAAAGAGAGTTTATCAAGAAATTCGATAGCATTCGTTATGATAGCGAGAAGAACCTGTTC

TGCTTTACTTTCGACTATAACAACTTTATAACTCAAAACACCGTGATGTCAAAAAGCTCA

TGGTCAGTCTACACCTATGGTGTAAGGATTAAAAGGCGTTTCGTGAATGGGAGATTCTCC

AATGAAAGTGACACGATCGACATAACAAAGGACATGGAGAAGACACTAGAGATGACTGAT

ATTAATTGGAGAGACGGACACGATCTGCGTCAAGATATAATTGATTATGAGATAGTACAG

CACATATTTGAGATCTTCCGTTTGACTGTCCAAATGCGTAATTCCCTTTCTGAGCTGGAA

GATAGGGACTATGATAGATTAATATCCCCTGTACTAAATGAGAACAACATTTTCTATGAT

AGTGCAAAAGCCGGGGATGCATTGCCGAAAGACGCTGACGCTAATGGGGCGTACTGTATA

GCTTTAAAGGGGCTTTACGAAATAAAGCAGATAACCGAAAACTGGAAGGAAGATGGCAAA

TTCTCAAGGGACAAACTTAAGATCTCTAACAAGGATTGGTTCGATTTTATACAAAACAAA

CGTTATTTG

SEQ ID NO: 36

ATGAATAATGGTACAAACAACTTTCAGAATTTCATTGGGATCTCTAGCTTACAGAAGACC

CTGAGGAATGCGTTGATTCCAACTGAAACAACCCAGCAATTCATCGTGAAAAATGGGATA

ATCAAAGAGGATGAGTTAAGGGGTGAAAACCGTCAAATATTGAAGGATATTATGGACGAC

TACTACCGTGGATTCATCTCAGAGACGTTGAGCAGCATTGACGACATAGACTGGACTAGC

CTTTTCGAGAAGATGGAAATTCAGTTAAAGAACGGAGATAACAAAGATACACTAATCAAG

GAACAGACAGAATACAGAAAAGCAATTCATAAGAAATTCGCTAATGACGATCGTTTTAAA

AACATGTTCTCTGCAAAATTAATTAGCGACATTCTGCCGGAATTCGTTATACATAATAAT

AACTACAGTGCTTCTGAAAAGGAAGAGAAAACTCAGGTAATAAAACTGTTCTCTCGTTTT

GCCACATCCTTCAAAGACTACTTTAAAAATAGAGCGAACTGCTTTAGCGCCGACGATATT

AGTTCTTCCTCATGCCACAGGATTGTCAACGATAATGCAGAGATATTCTTTTCTAACGCA

CTAGTCTACAGAAGGATTGTAAAGTCTTTGTCAAATGATGACATAAACAAGATTAGTGGA

GATATGAAAGACTCTCTAAAGGAAATGAGCCTTGAGGAGATATACTCTTATGAAAAGTAC

GGTGAGTTTATTACCCAAGAAGGCATTAGTTTCTATAATGACATTTGTGGAAAAGTTAAC

AGTTTTATGAATCTATACTGTCAAAAAAATAAGGAGAATAAAAATCTTTATAAGTTGCAA

AAACTGCATAAGCAGATATTATGTATAGCAGACACGAGCTATGAGGTACCGTACAAGTTC

GAGAGCGATGAGGAAGTCTACCAATCTGTCAACGGATTTTTGGACAACATTTCTTCAAAA

CATATTGTGGAGAGGCTTAGGAAAATAGGCGACAATTATAATGGATATAACTTAGATAAG

ATATATATTGTTTCCAAATTCTACGAATCTGTAAGCCAGAAGACATACAGAGATTGGGAA

ACGATAAACACAGCCCTTGAAATTCACTATAACAACATACTACCTGGAAACGGCAAATCA

AAGGCCGACAAAGTTAAGAAGGCCGTAAAGAATGATTTACAGAAGAGCATAACGGAGATC

AATGAGCTGGTGTCTAACTATAAATTGTGTAGCGATGACAACATAAAAGCCGAGACTTAC

ATTCACGAAATTTCACACATACTTAACAACTTTGAAGCTCAGGAATTAAAGTATAATCCC

-continued

GAAATACACCTTGTGGAGTCCGAACTAAAGGCTAGTGAGCTTAAGAACGTCCTAGACGTA

ATTATGAATGCCTTCCACTGGTGTAGTGTTTTTATGACCGAGGAACTTGTTGACAAAGAT

AATAATTTTTATGCAGAACTAGAAGAGATATACGATGAAATATACCCGGTGATCAGTTTG

TACAATCTTGTCAGGAACTATGTGACACAAAAGCCCTATTCAACAAAGAAAATAAAACTT

AATTTCGGAATTCCTACGTTAGCTGATGGCTGGTCTAAATCCAAGGAATACAGCAACAAC

GCTATAATTCTGATGAGAGATAACTTGTACTATCTAGGCATCTTCAATGCCAAAAATAAG

CCTGATAAGAAGATTATAGAGGGCAACACTTCAGAGAACAAGGGCGACTACAAGAAAATG

ATCTATAACCTATTGCCTGGCCCAAACAAGATGATTCCGAAGGTCTTCCTATCATCCAAG

ACCGGCGTTGAGACATACAAGCCATCAGCGTATATTTTAGAGGGGTACAAACAAAACAAG

CACATAAAGTCTAGTAAAGACTTCGATATAACATTTTGTCATGACTTAATTGACTACTTT

AAGAATTGCATCGCTATACACCCGGAATGGAAGAATTTCGGCTTCGACTTCTCTGATACA

TCTACCTACGAGGACATTAGCGGGTTTTACCGTGAAGTCGAATTACAAGGGTATAAGATA

GATTGGACGTACATCTCTGAGAAAGACATAGACTTGCTTCAGGAAAAGGGCCAGTTGTAT

CTATTCCAAATATACAATAAGGATTTTTCCAAGAAATCTACGGGTAATGACAATCTTCAC

ACAATGTATCTTAAGAACCTTTTCTCAGAAGAGAACCTGAAGGACATTGTCTTAAAACTA

AATGGCGAAGCTGAGATTTTTTTCAGGAAGTCTTCAATTAAGAACCCGATAATCCACAAG

AAGGGGAGTATTCTTGTGAATAGAACTTACGAGGCCGAAGAAAAAGACCAATTTGGTAAC

ATCCAGATAGTCAGAAAGAACATTCCAGAGAACATCTACCAAGAGCTATACAAATATTTC

AACGACAAGTCCGATAAGGAACTGTCCGATGAGGCAGCCAAGTTGAAGAATGTCGTGGGT

CATCATGAAGCTGCTACTAACATTGTCAAGGACTATCGTTATACTTACGACAAGTATTTC

CTACACATGCCGATAACAATTAATTTCAAGGCTAACAAAACAGGCTTTATCAACGATCGT

ATCTTGCAGTACATAGCTAAGGAAAAGGATTTGCATGTGATTGGCATTGATAGAGGGGAG

CGTAACTTGATATATGTGTCTGTCATAGACACGTGTGGCAACATCGTCGAACAGAAATCA

TTCAACATAGTAAACGGCTACGATTACCAAATTAAGCTGAAACAGCAAGAGGGTGCACGT

CAAATTGCGCGTAAAGAGTGGAAAGAAATTGGTAAAATCAAGGAAATTAAAGAAGGCTAC

TTGTCTCTTGTTATACATGAAATTTCCAAGATGGTTATAAAGTATAACGCGATAATTGCT

ATGGAAGACTTATCATACGGGTTTAAAAAGGGGAGGTTCAAGGTAGAGAGGCAGGTCTAT

CAAAAGTTCGAGACGATGTTGATTAATAAACTAAACTATCTAGTGTTCAAAGATATCAGC

ATTACGGAGAACGGGGGGCTACTGAAAGGATATCAACTAACGTACATTCCCGATAAGTTA

AAGAACGTTGGTCATCAATGTGGTTGCATCTTCTACGTGCCTGCTGCCTATACGTCCAAA

ATAGATCCAACTACTGGATTTGTTAACATCTTTAAATTCAAAGATTTAACCGTAGACGCC

AAAAGGGAATTTATAAAAAAATTTGACAGCATCCGTTACGATAGCGAAAAGAATCTGTTC

TGTTTTACTTTCGACTACAATAATTTCATCACGCAAAATACGGTAATGTCTAAGTCAAGT

TGGAGCGTCTACACGTATGGAGTCAGGATCAAGAGGCGTTTCGTAAATGGAAGATTCTCT

AATGAGTCAGATACTATAGACATCACGAAAGATATGGAGAAAACCTTGGAGATGACGGAT

ATTAACTGGCGTGATGGACACGATTTAAGACAGGACATTATTGACTATGAGATTGTGCAA

CACATCTTCGAAATATTCCGTCTAACAGTCCAAATGAGGAATAGCCTAAGTGAATTGGAG

GACCGTGATTACGATAGGCTTATAAGTCCTGTCCTTAACGAAAACAATATTTTCTATGAT

AGTGCTAAGGCGGGGGACGCACTGCCTAAAGACGCAGATGCTAACGGGGCATACTGCATT

-continued

GCGTTAAAGGGTCTGTACGAAATCAAGCAGATTACGGAAAACTGGAAAGAGGATGGCAAG

TTTAGCAGAGATAAGTTGAAGATAAGTAACAAAGATTGGTTTGACTTTATTCAGAATAAA

AGGTATTTA

SEQ ID NO: 37

ATGAATAACGGCACTAATAATTTCCAGAATTTCATCGGCATTAGCAGCTTACAAAAGACG

TTGAGGAATGCCTTAATACCCACAGAAACTACTCAACAATTTATAGTGAAGAATGGGATA

ATTAAGGAAGACGAGTTGAGAGGTGAAAATAGGCAAATCTTGAAAGACATTATGGATGAC

TACTACAGGGGCTTCATTAGTGAAACGTTGTCTTCAATAGATGACATTGATTGGACTTCT

TTGTTTGAGAAGATGGAAATACAGTTAAAGAACGGCGACAATAAGGATACACTTATCAAA

GAGCAAACAGAATATAGAAAAGCAATTCACAAAAAGTTTGCTAACGATGATAGGTTCAAG

AACATGTTTAGCGCTAAACTAATATCAGACATCCTTCCCGAGTTCGTTATTCATAACAAT

AACTATAGTGCAAGTGAAAAAGAGGAGAAGACACAGGTGATTAAGCTGTTCTCCAGATTC

GCGACTTCTTTCAAAGATTACTTCAAAAACAGAGCCAACTGTTTTTCAGCTGACGATATC

TCTAGTAGTAGTTGTCACCGTATAGTGAACGATAACGCTGAGATCTTCTTTAGCAATGCA

TTAGTGTATAGAAGGATAGTTAAGTCTCTAAGCAATGATGATATCAATAAAATTTCCGGA

GACATGAAGGACTCCCTAAAGGAAATGTCCTTAGAAGAGATCTACTCATATGAGAAATAC

GGGGAATTTATTACGCAGGAAGGGATCTCCTTTTACAATGACATATGCGGGAAGGTCAAC

TCTTTCATGAACTTATACTGCCAAAAGAACAAGGAGAACAAGAATTTATATAAACTTCAG

AAACTTCACAAACAAATACTGTGCATAGCCGATACCTCATATGAGGTTCCTTACAAATTT

GAATCAGATGAAGAGGTATACCAATCCGTTAACGGCTTTCTTGACAATATTAGCTCAAAG

CACATCGTGGAGAGGTTGAGAAAGATTGGTGATAATTATAATGGCTACAATCTAGATAAG

ATATATATTGTTAGCAAGTTCTACGAGTCTGTGTCCCAAAAAACATATAGGGATTGGGAG

ACAATTAATACTGCTCTAGAAATCCATTACAACAACATCCTTCCTGGAAATGGCAAGAGT

AAGGCCGACAAAGTCAAGAAAGCAGTGAAAAATGATCTGCAAAAATCAATTACTGAGATA

AACGAGCTAGTATCTAATTACAAGCTTTGTAGCGACGATAACATTAAGGCAGAAACGTAC

ATACACGAGATTAGTCACATCTTAAATAATTTTGAAGCCCAAGAACTGAAATATAACCCT

GAGATACACCTTGTTGAATCCGAGTTAAAGGCGTCTGAACTAAAAAACGTGTTAGACGTT

ATTATGAATGCCTTCCACTGGTGTAGCGTCTTTATGACTGAGGAGTTGGTTGATAAGGAT

AATAACTTTTACGCTGAATTGGAAGAAATTTATGACGAAATCTATCCTGTTATTTCTCTA

TATAATTTGGTGAGAAATTACGTAACGCAAAAGCCCTATAGTACGAAAAAAATAAAACTA

AATTTCGGGATCCCTACCCTAGCCGACGGTTGGTCTAAATCCAAGGAGTACTCAAACAAT

GCAATAATATTGATGAGGGACAACCTGTACTACCTAGGCATATTTAATGCCAAAAATAAG

CCCGATAAAAAGATTATAGAAGGGAACACGTCAGAAAATAAAGGAGACTATAAGAAAATG

ATCTACAACCTTTTGCCCGGCCCCAATAAAATGATCCCGAAGGTCTTCCTAAGTAGCAAG

ACTGGCGTAGAGACCTACAAACCATCTGCATACATTTTGGAGGGGTACAAGCAAAACAAG

CACATAAAGAGTAGTAAGGATTTTGACATTACATTCTGCCATGACTTAATTGACTACTTT

AAAAATTGCATCGCAATTCACCCTGAATGGAAAAATTTTGGATTTGATTTCTCTGATACT

TCAACATATGAGGATATTTCAGGGTTCTACAGGGAGGTCGAACTACAGGGTTACAAAATA

GACTGGACGTATATTTCTGAGAAAGATATAGATTTGCTTCAGGAAAAGGGTCAGCTATAT

CTGTTCCAGATATATAATAAGGACTTCTCCAAAAAGAGTACCGGAAATGATAATCTGCAC

ACAATGTACTTAAAAAACTTGTTCTCTGAGGAGAATCTAAAAGACATCGTACTAAAACTT

-continued

AACGGGGAGGCCGAAATTTTTTTAGGAAGTCCAGCATCAAGAACCCGATTATTCATAAA

AAAGGTAGCATTTTGGTGAACCGTACTTATGAGGCGGAAGAAAAAGACCAATTCGGTAAT

ATTCAAATCGTTAGAAAGAACATCCCTGAGAACATTTATCAGGAACTATACAAATACTTT

AACGACAAATCAGATAAGGAGCTTTCTGATGAGGCAGCTAAATTGAAAAATGTAGTGGGA

CATCACGAAGCAGCCACTAACATAGTGAAGGACTACAGATACACATACGATAAGTACTTC

CTGCACATGCCTATTACAATTAACTTTAAAGCAAATAAAACAGGGTTTATTAACGACAGA

ATCTTACAGTATATTGCCAAAGAAAAGGATCTGCATGTGATAGGAATAGACAGAGGAGAA

AGAAACCTGATATACGTCTCCGTGATTGATACATGTGGGAACATAGTAGAACAGAAGTCC

TTTAACATTGTTAATGGGTACGATTATCAAATTAAATTAAAACAACAAGAAGGAGCACGT

CAAATAGCTAGGAAAGAATGGAAAGAGATAGGAAAAATTAAGGAAATTAAGGAGGGTTAC

CTGTCCCTTGTAATTCATGAAATATCCAAAATGGTAATTAAATATAACGCGATCATCGCG

ATGGAAGATCTAAGCTACGGGTTCAAAAAAGGCAGGTTTAAGGTGGAGAGGCAAGTTTAC

CAAAAGTTCGAGACAATGTTGATTAATAAGTTAAACTACTTAGTTTTCAAAGATATCTCC

ATAACCGAGAATGGCGGGCTTTTAAAAGGGTACCAACTAACATATATCCCGGATAAATTG

AAGAACGTTGGACACCAGTGTGGCTGCATATTTTATGTACCCGCTGCGTATACTTCTAAA

ATTGACCCGACCACCGGGTTTGTAAACATATTCAAGTTTAAGGACCTAACAGTTGACGCC

AAACGTGAGTTCATCAAGAAGTTCGATAGTATAAGGTATGACTCTGAGAAGAACCTTTTC

TGCTTCACGTTTGACTATAATAATTTCATCACCCAAAATACAGTTATGTCAAAAAGCTCT

TGGTCAGTATATACGTATGGCGTAAGGATTAAGCGTAGGTTCGTGAACGGTAGATTTTCC

AACGAGTCAGATACTATTGATATTACCAAGGATATGGAGAAGACATTAGAAATGACAGAT

ATAAATTGGAGGGATGGGCACGATCTAAGGCAAGATATCATTGATTACGAAATTGTTCAG

CACATATTCGAGATATTCCGTCTTACAGTACAAATGCGTAACAGCTTGTCTGAGTTGGAA

GATCGTGACTATGACAGGTTGATATCACCGGTCTTGAACGAGAACAATATATTCTACGAC

AGCGCTAAGGCGGGAGACGCTCTGCCTAAAGACGCAGATGCCAATGGGGCGTACTGCATT

GCCTTAAAAGGCTTATACGAGATTAAACAGATCACAGAGAACTGGAAAGAGGACGGCAAG

TTTTCTAGAGATAAATTGAAAATCTCAAACAAAGACTGGTTCGATTTCATCCAAAACAAA

AGATACCTT

SEQ ID NO: 38

ATGAACAATGGAACTAACAACTTCCAGAACTTTATCGGCATCTCTTCCCTCCAAAAGACA

CTGAGAAATGCACTGATCCCAACCGAAACGACTCAACAATTTATTGTTAAGAACGGCATC

ATAAAAGAAGACGAGCTTCGCGGCGAGAACCGCCAGATACTTAAGGATATTATGGACGAT

TATTACCGAGGCTTTATCAGCGAAACTCTTAGCTCTATTGATGATATCGACTGGACCTCC

CTCTTCGAAAAAATGGAGATACAGCTCAAGAACGGCGATAATAAAGACACCTTGATAAAG

GAACAGACTGAGTACAGGAAAGCGATCCACAAGAAATTCGCGAACGACGACAGGTTTAAA

AACATGTTCTCTGCAAAATTGATATCCGACATCTTGCCGGAATTTGTGATACACAACAAT

AACTATAGCGCTTCAGAGAAAGAAGAGAAGACCCAAGTAATCAAGTTGTTCAGCCGCTTC

GCAACGTCTTTTAAAGATTACTTTAAGAACCGGGCCAATTGTTTCTCCGCGGATGATATT

AGCTCATCAAGTTGCCATCGAATTGTCAATGATAATGCGGAGATCTTCTTCAGCAATGCG

CTGGTCTACAGACGAATCGTAAAAAGTCTTTCAAATGACGACATCAATAAGATTAGTGGA

GATATGAAGGATTCCCTTAAGGAAATGAGTCTTGAAGAAATATACTCATACGAAAAGTAC

GGGGAATTTATTACCCAGGAGGGGATCTCCTTCTATAACGACATCTGTGGAAAAGTAAAC

-continued

TCATTCATGAACCTGTACTGTCAGAAAAACAAAGAAAACAAAAATCTGTATAAACTCCAA

AAATTGCACAAGCAAATATTGTGTATAGCGGACACATCATACGAGGTTCCATATAAGTTC

GAAAGTGATGAAGAAGTCTACCAATCAGTGAATGGGTTTCTGGACAACATTAGTTCCAAG

CACATAGTTGAACGACTGCGAAAGATTGGTGACAATTACAACGGCTATAATTTGGACAAG

ATTTATATAGTTAGCAAATTTTATGAATCCGTATCACAAAAGACTTATAGAGACTGGGAA

ACAATCAACACGGCACTTGAGATCCATTATAACAATATTCTTCCAGGGAACGGCAAAAGC

AAGGCTGATAAGGTAAAAAAGGCCGTTAAGAATGATCTTCAAAAATCCATAACGGAGATC

AACGAACTTGTAAGTAACTACAAATTGTGCTCTGACGACAATATAAAGGCTGAAACGTAT

ATTCACGAGATTAGCCATATCCTGAATAACTTTGAGGCCCAAGAACTCAAGTATAACCCG

GAAATACATTTGGTAGAAAGCGAGCTTAAAGCGAGTGAGCTGAAAAACGTCCTCGATGTG

ATCATGAATGCTTTCCACTGGTGTAGTGTCTTTATGACTGAGGAGTTGGTTGATAAAGAC

AATAATTTCTACGCTGAACTGGAAGAAATTTACGACGAAATCTATCCAGTGATCTCCCTC

TATAACCTCGTTCGAAACTACGTGACGCAGAAACCTTATTCTACAAAGAAAATTAAGTTG

AACTTCGGCATTCCTACACTTGCTGACGGATGGTCCAAATCCAAAGAGTACTCAAACAAC

GCAATCATCCTCATGCGGGATAACCTTTATTATTTGGGCATTTTCAACGCCAAAAACAAA

CCTGATAAAAAGATAATTGAAGGCAATACGAGTGAGAACAAGGGCGACTACAAAAAAATG

ATATATAACTTGTTGCCAGGCCCCAACAAGATGATTCCTAAAGTTTTTCTGTCTTCTAAG

ACTGGAGTTGAAACTTACAAACCCTCCGCCTACATTCTTGAAGGGTATAAACAGAATAAG

CACATAAAGTCCTCAAAGGATTTCGACATTACGTTTTGCCATGACCTCATCGACTATTTC

AAGAACTGTATCGCCATACATCCGGAGTGGAAGAATTTTGGATTTGATTTCTCCGACACA

TCTACCTATGAAGACATAAGCGGTTTCTACCGGGAGGTCGAGCTTCAGGGCTATAAGATA

GATTGGACATACATTAGTGAAAAAGATATCGATCTTCTGCAAGAAAAGGGACAACTTTAC

CTTTTTCAGATTTATAATAAAGACTTTTCAAAAAAGTCCACAGGGAACGATAATCTGCAC

ACCATGTATCTCAAGAATCTGTTTAGTGAAGAAAACCTTAAAGACATAGTTTTGAAGCTT

AACGGAGAGGCTGAGATTTTTTTTAGAAAGTCCTCAATTAAAAACCCTATAATACACAAG

AAAGGCTCTATTCTTGTTAACAGGACATATGAAGCCGAGGAGAAAGATCAGTTTGGCAAT

ATCCAGATTGTTCGCAAGAATATCCCGGAAAATATATATCAGGAGCTGTATAAATACTTT

AACGACAAGAGCGACAAGGAGCTGAGTGACGAGGCCGCGAAGCTTAAGAATGTAGTAGGT

CACCACGAAGCAGCCACCAATATCGTCAAAGACTATAGGTACACGTACGACAAGTACTTT

TTGCACATGCCTATAACTATAAACTTCAAAGCTAATAAAACTGGGTTTATTAATGACAGG

ATTCTCCAATACATCGCTAAAGAGAAGGATCTGCATGTAATTGGCATAGACAGAGGTGAG

AGAAACTTGATATATGTCAGCGTAATAGACACATGTGGCAATATCGTGGAACAGAAGTCT

TTTAACATCGTCAATGGTTACGACTACCAAATTAAGTTGAAACAGCAGGAAGGCGCACGA

CAGATCGCACGAAAGGAATGGAAAGAGATAGGCAAAATAAAAGAAATAAAGGAGGGCTAT

CTCAGTCTCGTTATACACGAAATTTCAAAAATGGTTATTAAGTACAATGCAATCATAGCG

ATGGAGGATCTCAGTTATGGGTTCAAAAAGGGTCGGTTTAAAGTTGAGCGCCAAGTGTAC

CAAAAGTTCGAGACAATGCTGATTAACAAGCTGAACTACCTCGTCTTCAAAGATATAAGT

ATTACGGAGAACGGTGGCCTTCTTAAAGGCTATCAACTTACTTACATCCCGGACAAGCTC

AAAAACGTAGGGCACCAATGCGGGTGTATTTTCTATGTGCCTGCGGCATATACGTCAAAG

ATTGACCCAACCACAGGATTCGTAAACATATTCAAGTTTAAGGACCTCACCGTTGATGCG

AAAAGGGAGTTCATTAAAAAATTTGATTCTATTCGATATGATAGTGAGAAAAATCTCTTT

-continued

TGTTTCACATTTGACTATAATAATTTTATTACTCAGAATACTGTCATGAGCAAGTCATCT

TGGTCAGTGTACACATACGGGGTGCGGATCAAACGCAGGTTCGTCAATGGTCGCTTCTCA

AACGAATCAGACACCATTGACATCACAAAGGACATGGAAAAAACCCTTGAGATGACCGAC

ATTAATTGGCGCGATGGTCATGATCTGCGGCAAGACATCATAGACTACGAAATCGTCCAA

CACATCTTTGAGATCTTTCGCTTGACGGTCCAAATGCGGAACTCCCTGTCCGAGCTCGAG

GATAGAGATTATGATCGGCTGATATCTCCCGTGCTTAATGAAAATAACATCTTCTACGAC

TCCGCCAAGGCGGGTGATGCCCTGCCGAAGGATGCGGATGCTAATGGCGCTTATTGCATT

GCTCTTAAGGGGCTCTATGAGATAAAGCAGATCACGGAAAACTGGAAAGAAGACGGTAAG

TTTAGTAGAGACAAGCTGAAGATCTCAAATAAAGACTGGTTTGATTTCATACAG. AAC.

AAG.CGG.TAC.CTG

SEQ ID NO: 39

ATGAACAATGGCACTAACAATTTTCAGAATTTCATCGGCATTTCAAGTCTGCAAAAAACT

CTGAGGAATGCTTTGATCCCTACTGAAACCACTCAGCAATTTATAGTCAAGAACGGTATA

ATTAAAGAAGATGAACTCAGGGGTGAAAATAGACAAATACTCAAGGACATTATGGATGAC

TATTATAGAGGCTTCATCTCAGAGACTCTCTCATCAATAGATGATATCGATTGGACTAGC

CTTTTCGAGAAAATGGAGATTCAGTTGAAAAATGGTGATAACAAAGATACGTTGATAAAG

GAACAGACCGAGTACAGGAAAGCCATTCATAAGAAATTTGCTAATGACGATAGATTTAAG

AATATGTTTAGTGCAAAACTGATTAGTGACATTCTGCCGGAGTTCGTTATCCATAATAAT

AACTACTCTGCATCCGAAAAGGAGGAAAAGACGCAAGTTATTAAACTGTTCAGCCGCTTC

GCCACAAGCTTCAAGGACTACTTCAAAAATAGAGCCAACTGCTTTTCTGCCGACGATATA

TCATCATCTTCATGCCATCGGATCGTTAACGATAACGCCGAGATATTCTTCAGCAACGCC

CTTGTATATCGAAGAATAGTCAAAAGTCTGAGTAATGATGATATTAATAAAATTAGCGGT

GATATGAAAGACTCCCTGAAGGAAATGTCACTGGAGGAAATTTATAGTTACGAAAAGTAC

GGCGAATTCATTACTCAAGAAGGCATATCCTTCTATAACGACATTTGCGGAAAGGTCAAC

TCATTCATGAACCTTTATTGCCAGAAGAATAAGGAGAATAAAAATCTTTACAAATTGCAA

AAACTTCACAAACAAATTCTTTGCATCGCGGATACGTCCTACGAAGTTCCTTACAAATTT

GAATCCGATGAGGAAGTGTATCAGAGTGTCAATGGATTTTTGGATAATATCTCTTCAAAA

CATATTGTGGAGAGATTGCGCAAAATAGGTGATAACTACAATGGCTACAACCTGGACAAG

ATTTATATTGTTAGCAAGTTCTATGAAAGTGTCAGTCAAAAGACCTACAGAGATTGGGAG

ACAATCAACACGGCGCTCGAAATACACTACAATAACATCCTCCCCGGCAATGGGAAGAGT

AAAGCCGATAAGGTTAAAAAAGCTGTTAAGAACGACCTCCAGAAATCCATCACGGAAATA

AACGAGCTGGTTTCCAACTATAAGCTGTGTAGCGATGATAATATTAAGGCTGAGACATAT

ATACATGAGATCAGCCACATTCTCAACAATTTCGAGGCACAGGAACTCAAATACAATCCC

GAGATTCACTTGGTGGAAAGTGAGTTGAAGGCGTCAGAGCTTAAGAATGTACTTGACGTA

ATAATGAATGCTTTTCATTGGTGCTCCGTGTTCATGACTGAGGAACTCGTGGATAAGGAT

AATAACTTTTATGCGGAGTTGGAAGAGATATACGATGAAATATACCCGGTTATCTCACTG

TATAATCTGGTCAGAAATTACGTGACCCAAAAGCCTTATAGTACAAAAAAAATAAAGTTG

AACTTCGGTATTCCGACATTGGCAGATGGTTGGTCCAAAAGCAAAGAATACTCTAATAAC

GCCATTATATTGATGCGAGACAATTTGTATTACCTTGGGATCTTTAACGCGAAAAACAAA

CCGGATAAGAAGATCATCGAAGGTAATACATCTGAGAATAAGGGGGATTACAAGAAGATG

ATTTATAATCTGTTGCCGGGGCCAAACAAGATGATTCCGAAGGTCTTTCTGTCATCTAAG

-continued

ACAGGAGTAGAGACCTACAAACCTTCTGCGTACATTTTGGAAGGCTACAAACAGAACAAG
CATATAAAATCTAGCAAGGACTTTGATATCACGTTTTGTCATGATCTGATAGATTATTTC
AAAAACTGCATCGCTATACATCCTGAGTGGAAGAATTTCGGCTTTGACTTTTCTGACACC
AGCACATACGAAGACATCTCAGGTTTCTACCGGGAAGTCGAGCTCCAGGGGTACAAGATT
GACTGGACATATATAAGTGAAAAAGACATCGACCTCCTCCAAGAGAAGGGCCAACTTTAC
CTGTTCCAGATCTATAACAAAGACTTTTCTAAAAAGTCCACGGGTAACGACAACTTGCAC
ACTATGTATCTGAAAAACTTGTTCTCTGAAGAGAACCTCAAGGACATCGTCCTGAAGCTT
AACGGGGAGGCGGAGATCTTCTTTAGAAAGTCCTCTATCAAAAATCCCATTATCCATAAA
AAGGGCTCTATACTCGTTAATAGGACATATGAAGCGGAGGAAAAAGATCAATTTGGGAAC
ATCCAGATCGTCCGGAAAAATATACCTGAGAATATCTATCAAGAGCTGTACAAGTATTTT
AATGATAAGTCAGACAAAGAGCTCAGTGATGAGGCGGCAAAGCTCAAGAACGTGGTGGGG
CATCATGAAGCTGCGACGAACATTGTCAAAGATTATAGATACACTTACGATAAATACTTC
CTCCACATGCCGATAACGATTAACTTCAAAGCCAATAAGACGGGGTTTATAAATGATCGG
ATCCTTCAGTACATTGCGAAAGAGAAAGACCTCCATGTGATCGGAATTGACCGAGGAGAA
AGGAATCTGATTTACGTGTCCGTGATTGATACTTGCGGGAATATAGTCGAGCAAAAGAGT
TTCAACATAGTCAACGGGTATGACTATCAGATAAAGCTCAAACAGCAGGAAGGTGCGAGG
CAAATTGCGCGCAAAGAGTGGAAGGAGATAGGCAAGATTAAAGAAATCAAGGAAGGTTAT
CTCAGCTTGGTGATCCATGAAATATCTAAGATGGTTATAAAGTACAATGCCATAATAGCC
ATGGAGGATCTTTCCTACGGGTTTAAGAAGGGCCGATTTAAAGTGGAGCGACAAGTTTAC
CAGAAGTTCGAAACCATGTTGATTAACAAACTTAACTATTTGGTGTTCAAGGATATAAGT
ATAACCGAAAACGGCGGTTTGCTTAAGGGTTATCAGCTCACGTATATTCCTGATAAACTT
AAAAACGTTGGACACCAGTGTGGATGTATCTTCTACGTGCCAGCCGCTTACACTAGTAAG
ATAGATCCTACCACGGGGTTTGTGAATATTTTTAAGTTTAAAGACTTGACAGTCGACGCC
AAAAGGGAATTTATAAAAAAGTTTGATTCTATCCGCTACGATAGTGAAAAAAATCTCTTT
TGCTTTACTTTCGACTATAACAACTTCATTACGCAGAACACTGTCATGAGTAAGTCCAGC
TGGAGCGTCTACACATATGGCGTCCGAATTAAACGACGATTTGTAAACGGGCGGTTTTCA
AACGAATCTGACACGATAGACATTACCAAGGATATGGAGAAGACACTTGAGATGACCGAC
ATAAACTGGGGGACGGTCACGATCTTCGGCAGGACATAATTGATTACGAAATCGTCCAGC
ATATATTCGAAATATTTCGACTTACAGTGCAAATGCGGAACAGTCTCTCTGAACTGGAAG
ATCGCGATTATGACCGGTTGATTTCTCCGGTCCTCAATGAAAATAACATATTTTATGATA
GTGCTAAGGCAGGTGATGCGTTGCCAAAGGATGCAGACGCTAATGGTGCCTATTGTATCG
CGCTCAAGGGATTGTACGAGATAAAGCAAATTACGGAGAACTGGAAGGAGGATGGTAAGT
TTAGCCGAGACAAGTTGAAGATTAGCAATAAAGACTGGTTTGATTTTATCCAAAACAAGA
GGTACCTG

SEQ ID NO: 40

ATGAATAACGGAACTAATAACTTTCAAAATTTCATAGGTATTTCAAGCTTGCAGAAGACC
CTGAGGAATGCCCTGATTCCAACCGAGACAACGCAGCAGTTCATAGTCAAAAATGGCATT
ATTAAGGAAGATGAGCTGCGGGGGGAAAACCGACAGATACTCAAGGATATTATGGACGAC
TATTACCGGGGATTTATCTCAGAAACGCTGAGCAGTATTGATGACATCGATTGGACCAGT
CTTTTCGAGAAAATGGAAATTCAACTTAAGAATGGTGACAATAAAGACACTCTCATAAAG
GAGCAAACTGAATACCGAAAAGCCATACACAAAAAGTTTGCCAACGATGACCGCTTTAAA

-continued

AACATGTTTTCAGCTAAGCTCATTAGCGACATTCTCCCCGAGTTTGTGATTCATAACAAT

AACTATAGCGCATCCGAGAAGGAGGAAAAAACCCAAGTTATCAAATTGTTCAGTAGATTC

GCTACGAGCTTTAAAGATTACTTTAAAAACCGGGCTAACTGCTTCAGTGCAGACGATATC

AGCTCCTCATCCTGTCATCGCATCGTCAATGATAATGCTGAGATCTTCTTTTCTAATGCA

CTGGTTTACCGCAGGATAGTTAAGTCTCTTAGTAACGACGACATCAACAAGATATCAGGA

GATATGAAGGATTCCCTTAAAGAAATGAGTCTCGAGGAGATATATTCTTATGAAAAATAC

GGCGAATTTATTACCCAAGAGGGCATTAGTTTCTATAATGACATATGCGGAAAAGTTAAT

AGTTTTATGAATCTCTATTGTCAGAAGAATAAGGAGAATAAGAACCTCTACAAATTGCAG

AAGTTGCACAAGCAAATTCTGTGTATCGCGGACACCTCTTACGAGGTCCCATATAAGTTC

GAGAGTGATGAAGAAGTATACCAGAGCGTTAATGGGTTCCTGGACAACATCTCAAGTAAA

CACATAGTCGAAAGGCTCCGAAAGATCGGTGATAACTATAACGGATATAATTTGGATAAA

ATTTATATAGTTAGCAAATTTTACGAGAGCGTCAGTCAGAAGACCTACCGGGACTGGGAG

ACCATAAACACAGCGCTGGAAATACATTATAACAACATACTGCCTGGGAACGGTAAGTCA

AAGGCAGACAAGGTTAAAAAGGCTGTGAAGAATGACCTGCAAAAATCAATTACAGAAATA

AATGAGTTGGTAAGTAATTACAAACTTTGCAGCGATGATAATATAAAGGCAGAGACGTAC

ATACATGAAATATCTCATATCCTCAACAATTTCGAAGCCCAAGAACTGAAGTACAACCCG

GAAATTCATCTTGTAGAGTCTGAGTTGAAGGCCTCCGAATTGAAAAACGTTCTTGACGTA

ATTATGAATGCCTTCCACTGGTGCTCAGTATTCATGACGGAAGAGCTCGTGGATAAAGAC

AACAATTTTTACGCTGAACTGGAAGAAATATATGACGAGATTTACCCCGTAATTTCACTC

TACAACTTGGTACGAAATTACGTTACCCAAAAGCCATACTCAACAAAAAAAATTAAACTG

AACTTCGGGATACCCACCCTCGCAGATGGATGGTCAAAGTCCAAAGAGTACAGTAACAAT

GCAATTATCCTGATGCGAGACAACCTTTATTACCTCGGGATTTTCAACGCTAAAAATAAA

CCTGATAAAAAAATAATTGAGGGTAATACCTCTGAAAACAAGGGGGATTATAAAAAGATG

ATATACAATCTGCTGCCTGGCCCGAACAAAATGATTCCTAAAGTCTTCTTGTCTTCCAAG

ACTGGAGTCGAAACCTACAAGCCAAGTGCTTATATACTCGAAGGGTACAAACAAAATAAG

CACATAAAATCCAGCAAGGATTTTGATATTACATTCTGCCACGATTTGATTGATTATTTT

AAGAACTGTATAGCCATCCACCCAGAATGGAAGAATTTTGGTTTTGATTTTAGCGATACC

TCAACATATGAGGATATCTCTGGCTTTTACCGCGAGGTAGAACTGCAAGGTTATAAGATC

GATTGGACTTATATTTCTGAAAAGGACATAGATCTCCTGCAAGAGAAAGGGCAACTTTAT

TTGTTTCAAATATACAACAAAGATTTTAGTAAGAAGAGTACTGGCAATGATAACCTTCAC

ACTATGTATCTGAAGAACCTTTTTTCTGAGGAGAACTTGAAGGACATAGTCCTTAAACTC

AATGGGGAAGCTGAAATATTCTTTCGCAAAAGCTCCATTAAAAACCCGATCATTCATAAA

AAGGGTTCCATCTTGGTAAACCGCACATACGAGGCGGAAGAAAAAGATCAGTTCGGAAAT

ATCCAGATCGTAAGGAAGAATATCCCCGAAAATATATACCAAGAGCTTTACAAATATTTT

AACGATAAGTCAGACAAGGAACTGTCAGACGAAGCAGCCAAGTTGAAGAATGTCGTAGGG

CACCACGAAGCAGCTACAAACATAGTTAAAGATTATCGGTACACCTACGATAAATATTTC

CTGCATATGCCAATAACCATAAACTTCAAAGCCAACAAAACAGGGTTCATCAATGACCGA

ATACTTCAGTATATAGCCAAGGAAAAAGACCTGCATGTTATAGGAATAGATAGAGGTGAG

CGCAACTTGATATATGTCAGCGTGATAGACACCTGCGGAAATATCGTCGAGCAAAAAAGT

TTCAACATTGTTAATGGCTACGATTACCAAATTAAATTGAAGCAGCAAGAGGGGGCTCGG

-continued

CAAATCGCGCGAAAGGAATGGAAAGAAATCGGGAAGATTAAAGAAATTAAAGAGGGCTAC

CTGTCTCTTGTAATTCACGAAATATCTAAGATGGTCATCAAGTATAATGCCATTATTGCG

ATGGAAGATCTGTCCTACGGATTTAAGAAAGGCAGGTTTAAAGTCGAAAGGCAGGTGTAC

CAGAAATTCGAGACCATGCTGATTAATAAGCTCAACTATCTCGTATTTAAGGATATTTCT

ATAACTGAAAATGGAGGGCTTCTCAAAGGATATCAACTCACATACATACCTGATAAGCTG

AAGAACGTAGGCCACCAGTGTGGATGCATATTCTATGTACCAGCTGCATACACAAGCAAG

ATCGATCCAACTACTGGGTTTGTCAATATCTTCAAATTTAAGGACTTGACGGTCGATGCC

AAACGGGAGTTCATCAAAAAGTTTGATAGTATTCGATATGATAGTGAGAAGAACTTGTTT

TGCTTCACATTTGACTACAACAATTTCATAACGCAAAATACGGTTATGTCTAAATCCTCA

TGGAGCGTCTACACTTACGGAGTGAGGATAAAGCGGCGCTTCGTAAATGGCAGGTTTAGC

AATGAATCCGACACGATTGACATAACCAAGGATATGGAGAAAACCCTCGAGATGACCGAT

ATAAATTGGCGGGATGGACACGATCTGCGACAAGACATAATCGATTATGAAATCGTGCAG

CACATATTTGAGATATTCAGGCTTACGGTCCAAATGAGAAATTCCCTTTCCGAACTTGAA

GACCGCGATTACGACCGACTGATAAGCCCCGTTCTGAACGAAAATAACATCTTCTACGAC

AGCGCTAAAGCGGGAGACGCGCTGCCGAAAGATGCGGACGCAAATGGAGCCTATTGTATC

GCCTTGAAAGGGTTGTACGAGATCAAACAGATAACCGAGAATTGGAAGGAGGATGGGAAG

TTTAGTCGAGACAAACTTAAAATAAGCAACAAGGACTGGTTCGACTTTATTCAAAACAAA

CGATATCTC

SEQ ID NO: 41

ATGAATAATGGTACTAACAATTTTCAAAACTTTATCGGCATCTCTTCACTTCAGAAAACT

CTTCGGAACGCCCTTATACCGACGGAGACAACGCAGCAGTTTATAGTTAAAAACGGGATC

ATTAAAGAAGATGAACTCAGAGGGGAAAACAGGCAAATATTGAAGGACATTATGGACGAT

TACTACCGGGGGTTTATTTCAGAGACCCTTTCATCTATTGATGACATAGATTGGACCTCC

CTTTTCGAGAAAATGGAGATACAATTGAAAAACGGCGACAATAAAGATACACTTATCAAG

GAACAAACTGAGTATCGCAAGGCGATTCACAAGAAGTTTGCGAATGACGATCGCTTTAAG

AATATGTTTTCTGCGAAGCTCATAAGTGACATTCTGCCTGAATTTGTCATTCATAACAAC

AATTATTCTGCTAGCGAAAAAGAGGAAAAAACTCAAGTCATTAAGCTTTTTAGCAGGTTC

GCTACTAGTTTTAAAGACTATTTTAAGAACCGGGCGAATTGCTTTAGCGCTGACGACATA

TCATCCTCATCCTGTCATCGCATAGTCAATGATAATGCAGAAATATTCTTTTCTAATGCG

CTCGTGTATCGGAGAATAGTGAAAAGCCTCTCTAACGATGACATTAACAAAATAAGCGGC

GATATGAAGGATAGTCTGAAGGAAATGTCCCTCGAAGAAATATACTCATACGAGAAGTAC

GGAGAATTTATCACCCAGGAAGGAATTAGTTTTTACAACGACATCTGTGGTAAGGTTAAC

TCTTTTATGAATCTGTATTGTCAAAAGAATAAAGAAAATAAAAATCTTTATAAGCTCCAA

AAGCTTCACAAACAAATCTTGTGCATTGCGGATACGTCATACGAAGTACCTTACAAATTT

GAAAGCGACGAAGAGGTGTATCAGTCAGTGAATGGGTTCCTTGACAATATTTCTAGCAAA

CATATTGTGGAGCGACTTCGAAAGATCGGTGATAATTACAATGGCTATAATTTGGATAAA

ATTTACATAGTTAGTAAGTTTTATGAATCCGTCTCACAAAAGACGTACCGAGATTGGGAG

ACCATCAACACTGCTCTGGAGATTCATTACAATAATATATTGCCTGGGAATGGGAAGTCA

AAGGCCGACAAGGTTAAAAAAGCCGTAAAAAACGATCTTCAAAAGTCCATTACCGAGATA

AATGAACTTGTATCCAACTATAAGTTGTGCTCTGACGATAATATTAAAGCAGAAACGTAT

ATCCACGAAATAAGTCACATCCTGAACAACTTCGAAGCTCAAGAGCTCAAGTATAATCCT

-continued

GAAATTCATCTCGTCGAAAGCGAGCTGAAAGCATCCGAGTTGAAGAATGTGCTTGATGTG

ATCATGAACGCATTCCATTGGTGCAGTGTGTTCATGACCGAAGAACTTGTAGACAAAGAC

AACAACTTCTACGCTGAATTGGAAGAGATTTACGATGAAATTTACCCCGTGATATCCCTC

TATAATCTGGTAAGAAATTACGTCACGCAAAAACCATACAGTACCAAGAAAATAAAGCTC

AACTTTGGTATTCCGACGTTGGCAGATGGGTGGAGTAAGAGCAAGGAGTATTCTAACAAT

GCAATCATCCTCATGCGCGACAATTTGTATTATCTGGGGATCTTCAACGCGAAAAATAAG

CCCGACAAAAAGATAATAGAAGGCAATACGTCCGAGAACAAAGGGGACTATAAGAAAATG

ATTTATAACCTTCTTCCAGGACCCAACAAGATGATCCCAAAGGTTTTCTTGAGTTCAAAA

ACCGGCGTAGAAACTTATAAACCGTCCGCCTACATTCTGGAAGGGTACAAGCAAAACAAG

CACATTAAGTCATCTAAGGATTTCGACATTACTTTTTGTCATGATTTGATAGACTACTTC

AAAAATTGTATAGCGATACATCCGGAATGGAAAAATTTTGGGTTCGATTTTTCCGACACA

AGTACTTATGAAGACATCTCAGGGTTTTATAGGGAAGTTGAACTGCAAGGTTACAAAATA

GACTGGACTTATATTAGTGAGAAGGACATTGATTTGCTCCAGGAAAAGGGTCAATTGTAT

CTGTTCCAGATATATAACAAGGATTTCTCTAAAAAATCTACAGGTAACGACAATCTCCAC

ACGATGTACCTCAAGAATCTCTTCAGCGAAGAGAATTTGAAGGATATCGTACTTAAGCTC

AATGGAGAAGCGGAAATATTCTTCAGAAAGTCCAGCATTAAGAATCCTATAATTCACAAG

AAAGGGTCAATTCTCGTAAACCGGACTTATGAGGCCGAAGAAAAAGATCAGTTTGGTAAC

ATTCAGATTGTACGGAAAAACATTCCCGAGAACATCTATCAAGAACTGTATAAATACTTT

AATGATAAATCCGACAAGGAACTTTCTGACGAGGCTGCAAAATTGAAGAACGTAGTGGGA

CACCATGAGGCCGCAACCAATATAGTAAAGGATTACAGATACACTTATGATAAGTATTTC

CTCCATATGCCGATCACGATTAATTTCAAGGCGAATAAAACCGGCTTCATTAACGATCGC

ATTTTGCAATATATTGCGAAGGAAAAGGATTTGCACGTGATAGGTATAGACCGGGGTGAA

CGAAACTTGATTTACGTCTCTGTGATCGACACATGCGGAAATATAGTTGAACAGAAGTCC

TTTAATATTGTGAATGGTTACGACTACCAGATAAAATTGAAGCAACAGGAGGGCGCAAGA

CAGATAGCTCGCAAAGAGTGGAAGGAAATCGGCAAGATCAAAGAAATAAAGGAGGGTTAT

CTTTCCCTGGTAATTCATGAAATTAGCAAGATGGTTATTAAGTATAATGCTATAATAGCT

ATGGAGGACCTTTCCTATGGGTTCAAGAAAGGTCGCTTCAAAGTGGAGCGACAAGTGTAT

CAAAAGTTCGAGACTATGTTGATAAATAAATTGAATTATTTGGTTTTTAAAGACATTTCA

ATAACTGAGAACGGGGGTCTCTTGAAGGGGTACCAATTGACTTATATTCCGGACAAGTTG

AAGAATGTCGGACACCAGTGTGGTTGCATTTTCTACGTGCCTGCCGCTTACACCTCAAAA

ATCGATCCGACCACTGGTTTTGTAAATATATTTAAATTCAAAGATCTCACCGTTGATGCC

AAACGGGAGTTTATCAAAAAATTCGATTCCATTCGCTACGACTCTGAGAAAAACCTTTTT

TGTTTCACGTTCGATTATAACAACTTTATAACCCAAAATACTGTAATGTCCAAGTCAAGT

TGGTCTGTCTATACTTACGGAGTAAGGATCAAGCGCCGCTTCGTTAATGGGAGATTCTCA

AACGAGTCTGATACCATAGACATAACTAAAGACATGGAAAAAACCCTGGAAATGACGGAC

ATCAATTGGCGAGACGGGCATGATCTTCGACAGGACATAATAGATTACGAAATTGTTCAA

CACATTTTCGAGATATTTCGACTTACGGTTCAGATGAGGAATTCCCTTTCCGAATTGGAA

GACCGGGATTATGATCGACTTATATCTCCCGTGCTCAATGAAAACAATATTTTTTATGAT

-continued

TCAGCGAAAGCTGGGGACGCGCTGCCAAAAGATGCCGATGCCAATGGAGCATACTGTATC

GCCCTGAAGGGTTTGTATGAGATTAAGCAAATTACTGAAAACTGGAAGGAAGATGGCAAG

TTTTCTAGAGATAAGCTTAAGATTAGCAATAAGGACTGGTTTGACTTCATTCAAAATAAA

AGGTATCTT

SEQ ID NO: 42

ATGAATAATGGAACAAATAATTTTCAAAATTTTATTGGTATCAGTTCATTGCAAAAGACT

TTGAGAAATGCTTTGATCCCGACTGAGACCACACAGCAGTTCATCGTCAAAAATGGCATA

ATCAAGGAAGACGAACTTAGGGGTGAGAATAGACAAATATTGAAGGACATCATGGATGAC

TATTATAGGGGGTTCATTTCCGAAACGCTCAGTAGTATTGATGACATTGACTGGACTAGT

CTTTTCGAGAAAATGGAAATTCAGCTTAAGAACGGGGACAATAAAGACACGCTGATCAAG

GAGCAAACGGAATATAGGAAGGCGATCCATAAAAAATTCGCGAATGATGATCGGTTTAAA

AACATGTTTAGTGCCAAGTTGATCAGCGACATACTGCCCGAATTCGTGATCCACAACAAT

AATTACAGCGCCTCCGAAAAGGAGGAAAAAACTCAGGTCATTAAATTGTTTAGCCGATTC

GCAACGAGTTTCAAAGATTATTTTAAGAACCGGGCCAACTGTTTTTCAGCGGATGATATT

AGCTCCAGCAGCTGCCATCGCATAGTAAATGATAACGCTGAAATCTTTTTAGCAACGCA

CTTGTCTACCGGAGGATTGTAAAATCACTGTCAAATGATGACATTAACAAAATATCTGGA

GATATGAAGGACTCACTCAAAGAAATGAGCCTGGAAGAAATATATTCATACGAAAAATAC

GGGGAGTTTATTACCCAGGAAGGTATCAGTTTTTATAATGATATATGTGGAAAAGTTAAT

TCATTTATGAATCTTTACTGTCAAAAAAATAAGGAGAACAAGAATTTGTACAAGCTCCAA

AAACTTCATAAACAGATTCTGTGCATCGCAGACACAAGTTATGAGGTACCGTACAAATTT

GAGAGCGACGAAGAAGTTTATCAGAGTGTGAATGGTTTCCTGGACAATATCTCTTCTAAA

CACATTGTTGAGAGGCTTAGGAAGATCGGTGATAATTATAACGGCTATAATCTGGACAAA

ATTTATATTGTATCAAAGTTTTATGAATCAGTCTCTCAAAAGACGTATCGGGATTGGGAA

ACAATTAACACGGCTCTGGAGATCCACTACAATAACATTCTGCCCGGCAACGGGAAGAGC

AAAGCTGATAAGGTCAAGAAGGCAGTCAAGAACGACCTTCAGAAGAGCATAACAGAAATT

AACGAATTGGTCAGTAACTACAAACTGTGTAGTGATGACAACATAAAAGCCGAAACATAC

ATCCATGAAATAAGCCATATCCTGAATAACTTCGAAGCCCAAGAACTTAAATACAATCCC

GAGATTCATCTTGTCGAATCAGAACTCAAGGCGTCCGAGCTCAAAAATGTCCTTGACGTG

ATAATGAATGCCTTCCACTGGTGCAGCGTATTCATGACGGAGGAGTTGGTAGATAAAGAC

AACAACTTTTATGCCGAATTGGAAGAGATTTATGATGAGATTTACCCCGTTATTTCTCTG

TACAACTTGGTTCGAAACTACGTAACACAAAAACCATACTCAACCAAAAAGATCAAACTC

AATTTTGGCATACCTACATTGGCTGATGGTTGGTCCAAGTCAAAGGAATATAGCAATAAT

GCAATAATTCTCATGCGAGATAACTTGTATTATTTGGGGATCTTTAACGCTAAGAACAAA

CCAGATAAAAAGATAATCGAGGGGAACACAAGTGAGAACAAGGGTGATTACAAAAAAATG

ATTTACAATCTGCTTCCTGGGCCTAACAAAATGATTCCGAAGGTGTTTCTTAGCTCTAAA

ACTGGAGTGGAGACGTATAAGCCTTCCGCGTACATTCTCGAAGGCTACAAGCAAAATAAG

CATATCAAGTCCAGTAAGGACTTCGACATCACTTTTTGCCACGATCTCATCGATTACTTT

AAGAACTGTATCGCAATACACCCCGAGTGGAAAAACTTTGGTTTTGATTTTTCAGACACT

AGTACCTACGAGGACATTTCCGGCTTCTATCGAGAAGTCGAACTCCAGGGCTACAAAATC

GATTGGACGTACATTTCTGAGAAGGACATCGACTTGCTCCAAGAGAAAGGTCAACTTTAC

CTCTTCCAAATTTACAATAAAGACTTTTCAAAGAAGAGCACCGGTAATGACAACTTGCAT

-continued

```
ACCATGTATCTGAAGAACCTGTTTTCTGAGGAGAACCTCAAGGATATTGTATTGAAGTTG

AATGGCGAAGCAGAAATATTTTTCCGAAAGTCATCTATCAAGAACCCCATTATACACAAA

AAAGGCTCTATCCTGGTGAACCGGACTTACGAGGCAGAGGAGAAGGATCAATTCGGAAAC

ATACAGATAGTCCGCAAAAACATCCCTGAGAATATCTATCAGGAACTCTATAAGTACTTC

AATGATAAATCAGACAAGGAGCTTAGCGACGAAGCAGCTAAACTTAAAAACGTGGTTGGC

CATCACGAGGCCGCTACCAACATAGTCAAAGACTACCGCTATACTTATGACAAGTACTTT

TTGCACATGCCCATAACAATTAATTTCAAAGCTAACAAAACAGGGTTTATAAATGACAGA

ATCCTCCAATACATCGCCAAAGAGAAGGACCTCCATGTAATCGGGATTGATAGAGGCGAA

CGGAACTTGATTTACGTTAGTGTCATTGATACCTGTGGTAACATTGTCGAACAAAAGTCA

TTCAACATAGTCAATGGATATGATTATCAGATAAAACTCAAGCAACAAGAAGGCGCGAGG

CAGATTGCCAGGAAGGAATGGAAAGAAATCGGGAAGATCAAGGAGATCAAGGAGGGTTAC

CTGTCCTTGGTGATACACGAGATTTCAAAAATGGTTATAAAATACAATGCCATTATCGCG

ATGGAGGATTTGTCTTATGGATTTAAGAAGGGGAGGTTCAAAGTCGAACGACAAGTCTAT

CAGAAGTTTGAAACAATGCTCATTAACAAGCTCAATTACCTTGTTTTCAAGGATATAAGC

ATCACTGAAAACGGCGGACTCCTTAAGGGATATCAGCTGACTTATATCCCCGACAAGCTC

AAGAACGTAGGGCACCAATGCGGATGCATCTTTTACGTGCCTGCAGCATATACTTCAAAA

ATTGATCCGACTACTGGCTTTGTTAACATTTTCAAGTTCAAGGATCTGACGGTAGACGCT

AAGAGAGAATTCATAAAAAAGTTTGACAGCATCAGGTACGATAGTGAAAAGAACCTTTTT

TGTTTTACCTTTGACTACAATAATTTTATTACGCAAAATACAGTTATGAGCAAATCAAGT

TGGAGCGTTTACACATATGGCGTTCGGATCAAGCGCAGATTCGTCAATGGTCGCTTCTCA

AATGAGAGCGATACAATCGATATAACGAAGGATATGGAGAAGACGCTTGAGATGACAGAT

ATCAACTGGCGGGACGGACATGACCTTAGACAAGACATAATCGATTACGAAATAGTACAG

CATATCTTTGAGATTTTTAGGCTTACAGTTCAGATGCGGAACTCTCTTTCCGAACTGGAG

GACCGGGATTATGATCGGTTGATCTCCCCAGTACTGAACGAAAATAATATCTTTTACGAT

AGCGCGAAGGCTGGTGATGCACTCCCAAAAGACGCTGATGCGAACGGAGCTTATTGCATA

GCCCTTAAAGGGCTTTACGAGATTAAACAAATAACAGAAAATTGGAAGGAAGATGGCAAA

TTTTCCCGCGACAAGTTGAAGATTAGTAACAAAGACTGGTTCGACTTCATTCAGAATAAA

CGCTACCTC
```

Nucleic acid-guided nucleases can encompass a native sequence, an engineered sequence, or engineered nucleotide sequences of synthetized variants. Non-limiting examples of types of engineering that can be done to obtain a non-naturally occurring nuclease system are as follows. Engineering can include codon optimization to facilitate expression or improve expression in a host cell, such as a heterologous host cell. Engineering can reduce the size or molecular weight of the nuclease in order to facilitate expression or delivery. Engineering can alter PAM selection in order to change PAM specificity or to broaden the range of recognized PAMs. Engineering can alter, increase, or decrease stability, processivity, specificity, or efficiency of a targetable nuclease system. Engineering can alter, increase, or decrease protein stability. Engineering can alter, increase, or decrease processivity of nucleic acid scanning. Engineering can alter, increase, or decrease target sequence specificity. Engineering can alter, increase, or decrease nuclease activity. Engineering can alter, increase, or decrease editing efficiency. Engineering can alter, increase, or decrease transformation efficiency. Engineering can alter, increase, or decrease nuclease or guide nucleic acid expression. As used herein, a non-naturally occurring nucleic acid sequence can be an engineered sequence or engineered nucleotide sequences of synthetized variants. Such non-naturally occurring nucleic acid sequences can be amplified, cloned, assembled, synthesized, generated from synthesized oligonucleotides or dNTPs, or otherwise obtained using methods known by those skilled in the art. In certain embodiments, examples of non-naturally occurring nucleic acid-guided nucleases disclosed herein can include those nucleic acid-guided nucleases with engineered polypeptide sequences (e.g., SEQ ID NOs: 2-4) and those nucleotide sequences of synthetized variants (e.g., SEQ ID NOs: 43-63).

SEQ ID NO: 2
MGHHHHHHSSGVDLGTENLYFQSPAAKKKKLDGSVDMNNGTNNFQNFIGISSLQKTLRNA

LIPTETTQQFIVKNGIIKEDELRGENRQILKDIMDDYYRGFISETLSSIDDIDWTSLFEK

MEIQLKNGDNKDTLIKEQTEYRKAIHKKFANDDRFKNMFSAKLISDILPEFVIHNNNYSA

SEKEEKTQVIKLFSRFATSFKDYFKNRANCFSADDISSSSCHRIVNDNAEIFFSNALVYR

RIVKSLSNDDINKISGDMKDSLKEMSLEEIYSYEKYGEFITQEGISFYNDICGKVNSFMN

LYCQKNKENKNLYKLQKLHKQILCIADTSYEVPYKFESDEEVYQSVNGFLDNISSKHIVE

RLRKIGDNYNGYNLDKIYIVSKFYESVSQKTYRDWETINTALEIHYNNILPGNGKSKADK

VKKAVKNDLQKSITEINELVSNYKLCSDDNIKAETYIHEISHILNNFEAQELKYNPEIHL

VESELKASELKNVLDVIMNAFHWCSVFMTEELVDKDNNFYAELEEIYDEIYPVISLYNLV

RNYVTQKPYSTKKIKLNFGIPTLADGWSKSKEYSNNAIILMRDNLYYLGIFNAKNKPDKK

IIEGNTSENKGDYKKMIYNLLPGPNKMIPKVFLSSKTGVETYKPSAYILEGYKQNKHIKS

SKDFDITFCHDLIDYFKNCIAIHPEWKNFGFDFSDTSTYEDISGFYREVELQGYKIDWTY

ISEKDIDLLQEKGQLYLFQIYNKDFSKKSTGNDNLHTMYLKNLFSEENLKDIVLKLNGEA

EIFFRKSSIKNPIIHKKGSILVNRTYEAEEKDQFGNIQIVRKNIPENIYQELYKYFNDKS

DKELSDEAAKLKNVVGHHEAATNIVKDYRYTYDKYFLHMPITINFKANKTGFINDRILQY

IAKEKDLHVIGIDRGERNLIYVSVIDTCGNIVEQKSFNIVNGYDYQIKLKQQEGARQIAR

KEWKEIGKIKEIKEGYLSLVIHEISKMVIKYNAIIAMEDLSYGFKKGRFKVERQVYQKFE

TMLINKLNYLVFKDISITENGGLLKGYQLTYIPDKLKNVGHQCGCIFYVPAAYTSKIDPT

TGFVNIFKFKDLTVDAKREFIKKFDSIRYDSEKNLFCFTFDYNNFITQNTVMSKSSWSVY

TYGVRIKRRFVNGRFSNESDTIDITKDMEKTLEMTDINWRDGHDLRQDIIDYEIVQHIFE

IFRLTVQMRNSLSELEDRDYDRLISPVLNENNIFYDSAKAGDALPKDADANGAYCIALKG

LYEIKQITENWKEDGKFSRDKLKISNKDWFDFIQNKRYLKRPAATKKAGQAKKKKASGSG

AGSPKKKRKVEDPKKKRKVIPG*

SEQ ID NO: 3
SPAAKKKKLDGSVDMNNGTNNFQNFIGISSLQKTLRNALIPTETTQQFIVKNGIIKEDEL

RGENRQILKDIMDDYYRGFISETLSSIDDIDWTSLFEKMEIQLKNGDNKDTLIKEQTEYR

KAIHKKFANDDRFKNMFSAKLISDILPEFVIHNNNYSASEKEEKTQVIKLFSRFATSFKD

YFKNRANCFSADDISSSSCHRIVNDNAEIFFSNALVYRRIVKSLSNDDINKISGDMKDSL

KEMSLEEIYSYEKYGEFITQEGISFYNDICGKVNSFMNLYCQKNKENKNLYKLQKLHKQI

LCIADTSYEVPYKFESDEEVYQSVNGFLDNISSKHIVERLRKIGDNYNGYNLDKIYIVSK

FYESVSQKTYRDWETINTALEIHYNNILPGNGKSKADKVKKAVKNDLQKSITEINELVSN

YKLCSDDNIKAETYIHEISHILNNFEAQELKYNPEIHLVESELKASELKNVLDVIMNAFH

WCSVFMTEELVDKDNNFYAELEEIYDEIYPVISLYNLVRNYVTQKPYSTKKIKLNFGIPT

LADGWSKSKEYSNNAIILMRDNLYYLGIFNAKNKPDKKIIEGNTSENKGDYKKMIYNLLP

GPNKMIPKVFLSSKTGVETYKPSAYILEGYKQNKHIKSSKDFDITFCHDLIDYFKNCIAI

HPEWKNFGFDFSDTSTYEDISGFYREVELQGYKIDWTYISEKDIDLLQEKGQLYLFQIYN

KDFSKKSTGNDNLHTMYLKNLFSEENLKDIVLKLNGEAEIFFRKSSIKNPIIHKKGSILV

NRTYEAEEKDQFGNIQIVRKNIPENIYQELYKYFNDKSDKELSDEAAKLKNVVGHHEAAT

NIVKDYRYTYDKYFLHMPITINFKANKTGFINDRILQYIAKEKDLHVIGIDRGERNLIYV

SVIDTCGNIVEQKSFNIVNGYDYQIKLKQQEGARQIARKEWKEIGKIKEIKEGYLSLVIH

EISKMVIKYNAIIAMEDLSYGFKKGRFKVERQVYQKFETMLINKLNYLVFKDISITENGG

-continued

LLKGYQLTYIPDKLKNVGHQCGCIFYVPAAYTSKIDPTTGFVNIFKFKDLTVDAKREFIK

KFDSIRYDSEKNLFCFTFDYNNFITQNTVMSKSSWSVYTYGVRIKRRFVNGRFSNESDTI

DITKDMEKTLEMTDINWRDGHDLRQDIIDYEIVQHIFEIFRLTVQMRNSLSELEDRDYDR

LISPVLNENNIFYDSAKAGDALPKDADANGAYCIALKGLYEIKQITENWKEDGKFSRDKL

KISNKDWFDFIQNKRYLKRPAATKKAGQAKKKKASGSGAGSPKKKRKVEDPKKKRKVIPG

*

SEQ ID NO: 4

PAAKKKKLDGSVDMNNGTNNFQNFIGISSLQKTLRNALIPTETTQQFIVKNGIIKEDELR

GENRQILKDIMDDYYRGFISETLSSIDDIDWTSLFEKMEIQLKNGDNKDTLIKEQTEYRK

AIHKKFANDDRFKNMFSAKLISDILPEFVIHNNNYSASEKEEKTQVIKLFSRFATSFKDY

FKNRANCFSADDISSSSCHRIVNDNAEIFFSNALVYRRIVKSLSNDDINKISGDMKDSLK

EMSLEEIYSYEKYGEFITQEGISFYNDICGKVNSFMNLYCQKNKENKNLYKLQKLHKQIL

CIADTSYEVPYKFESDEEVYQSVNGFLDNISSKHIVERLRKIGDNYNGYNLDKIYIVSKF

YESVSQKTYRDWETINTALEIHYNNILPGNGKSKADKVKKAVKNDLQKSITEINELVSNY

KLCSDDNIKAETYIHEISHILNNFEAQELKYNPEIHLVESELKASELKNVLDVIMNAFHW

CSVFMTEELVDKDNNFYAELEEIYDEIYPVISLYNLVRNYVTQKPYSTKKIKLNFGIPTL

ADGWSKSKEYSNNAIILMRDNLYYLGIFNAKNKPDKKIIEGNTSENKGDYKKMIYNLLPG

PNKMIPKVFLSSKTGVETYKPSAYILEGYKQNKHIKSSKDFDITFCHDLIDYFKNCIAIH

PEWKNFGFDFSDTSTYEDISGFYREVELQGYKIDWTYISEKDIDLLQEKGQLYLFQIYNK

DFSKKSTGNDNLHTMYLKNLFSEENLKDIVLKLNGEAEIFFRKSSIKNPIIHKKGSILVN

RTYEAEEKDQFGNIQIVRKNIPENIYQELYKYFNDKSDKELSDEAAKLKNVVGHHEAATN

IVKDYRYTYDKYFLHMPITINFKANKTGFINDRILQYIAKEKDLHVIGIDRGERNLIYVS

VIDTCGNIVEQKSFNIVNGYDYQIKLKQQEGARQIARKEWKEIGKIKEIKEGYLSLVIHE

ISKMVIKYNAIIAMEDLSYGFKKGRFKVERQVYQKFETMLINKLNYLVFKDISITENGGL

LKGYQLTYIPDKLKNVGHQCGCIFYVPAAYTSKIDPTTGFVNIFKFKDLTVDAKREFIKK

FDSIRYDSEKNLFCFTFDYNNFITQNTVMSKSSWSVYTYGVRIKRRFVNGRFSNESDTID

ITKDMEKTLEMTDINWRDGHDLRQDIIDYEIVQHIFEIFRLTVQMRNSLSELEDRDYDRL

ISPVLNENNIFYDSAKAGDALPKDADANGAYCIALKGLYEIKQITENWKEDGKFSRDKLK

ISNKDWFDFIQNKRYLKRPAATKKAGQAKKKKASGSGAGSPKKKRKVEDPKKKRKVIPG*

SEQ ID NO: 109:

SMSRRRKANPTKLSENAKKLAKEVENASGSGAGSKRPAATKKAGQAKKKKASGSGAGSPA

AKKKKLDGSVDASGSGAGSPKKKRKVEDASGSGAGSPKKKRKVASGSGAGSMNNGTNNFQ

NFIGISSLQKTLRNALIPTETTQQFIVKNGIIKEDELRGENRQILKDIMDDYYRGFISET

LSSIDDIDWTSLFEKMEIQLKNGDNKDTLIKEQTEYRKAIHKKFANDDRFKNMFSAKLIS

DILPEFVIHNNNYSASEKEEKTQVIKLFSRFATSFKDYFKNRANCFSADDISSSSCHRIV

NDNAEIFFSNALVYRRIVKSLSNDDINKISGDMKDSLKEMSLEEIYSYEKYGEFITQEGI

SFYNDICGKVNSFMNLYCQKNKENKNLYKLQKLHKQILCIADTSYEVPYKFESDEEVYQS

VNGELDNISSKHIVERLRKIGDNYNGYNLDKIYIVSKFYESVSQKTYRDWETINTALEIH

YNNILPGNGKSKADKVKKAVKNDLQKSITEINELVSNYKLCSDDNIKAETYIHEISHILN

NFEAQELKYNPEIHLVESELKASELKNVLDVIMNAFHWCSVFMTEELVDKDNNFYAELEE

IYDEIYPVISLYNLVRNYVTQKPYSTKKIKLNFGIPTLADGWSKSKEYSNNAIILMRDNL

-continued

YYLGIFNAKNKPDKKIIEGNTSENKGDYKKMIYNLLPGPNKMIPKVFLSSKTGVETYKPS

AYILEGYKQNKHIKSSKDFDITFCHDLIDYFKNCIAIHPEWKNFGFDFSDTSTYEDISGF

YREVELQGYKIDWTYISEKDIDLLQEKGQLYLFQIYNKDFSKKSTGNDNLHTMYLKNLFS

EENLKDIVLKLNGEAEIFFRKSSIKNPIIHKKGSILVNRTYEAEEKDQFGNIQIVRKNIP

ENIYQELYKYFNDKSDKELSDEAAKLKNVVGHHEAATNIVKDYRYTYDKYFLHMPITINF

KANKTGFINDRILQYIAKEKDLHVIGIDRGERNLIYVSVIDTCGNIVEQKSFNIVNGYDY

QIKLKQQEGARQIARKEWKEIGKIKEIKEGYLSLVIHEISKMVIKYNAIIAMEDLSYGFK

KGRFKVERQVYQKFETMLINKLNYLVFKDISITENGGLLKGYQLTYIPDKLKNVGHQCGC

IFYVPAAYTSKIDPTTGFVNIFKFKDLTVDAKREFIKKFDSIRYDSEKNLFCFTFDYNNF

ITQNTVMSKSSWSVYTYGVRIKRRFVNGRFSNESDTIDITKDMEKTLEMTDINWRDGHDL

RQDIIDYEIVQHIFEIFRLTVQMRNSLSELEDRDYDRLISPVLNENNIFYDSAKAGDALP

KDADANGAYCIALKGLYEIKQITENWKEDGKFSRDKLKISNKDWFDFIQNKRYL

SEQ ID NO: 110:

MSRRRKANPTKLSENAKKLAKEVENASGSGAGSKRPAATKKAGQAKKKKASGSGAGSPAA

KKKKLDGSVDASGSGAGSPKKKRKVEDASGSGAGSPKKKRKVASGSGAGSMNNGTNNFQN

FIGISSLQKTLRNALIPTETTQQFIVKNGIIKEDELRGENRQILKDIMDDYYRGFISETL

SSIDDIDWTSLFEKMEIQLKNGDNKDTLIKEQTEYRKAIHKKFANDDRFKNMFSAKLISD

ILPEFVIHNNNYSASEKEEKTQVIKLFSRFATSFKDYFKNRANCFSADDISSSSCHRIVN

DNAEIFFSNALVYRRIVKSLSNDDINKISGDMKDSLKEMSLEEIYSYEKYGEFITQEGIS

FYNDICGKVNSFMNLYCQKNKENKNLYKLQKLHKQILCIADTSYEVPYKFESDEEVYQSV

NGFLDNISSKHIVERLRKIGDNYNGYNLDKIYIVSKFYESVSQKTYRDWETINTALEIHY

NNILPGNGKSKADKVKKAVKNDLQKSITEINELVSNYKLCSDDNIKAETYIHEISHILNN

FEAQELKYNPEIHLVESELKASELKNVLDVIMNAFHWCSVFMTEELVDKDNNFYAELEEI

YDEIYPVISLYNLVRNYVTQKPYSTKKIKLNFGIPTLADGWSKSKEYSNNAIILMRDNLY

YLGIFNAKNKPDKKIIEGNTSENKGDYKKMIYNLLPGPNKMIPKVFLSSKTGVETYKPSA

YILEGYKQNKHIKSSKDFDITFCHDLIDYFKNCIAIHPEWKNFGFDFSDTSTYEDISGFY

REVELQGYKIDWTYISEKDIDLLQEKGQLYLFQIYNKDFSKKSTGNDNLHTMYLKNLFSE

ENLKDIVLKLNGEAEIFFRKSSIKNPIIHKKGSILVNRTYEAEEKDQFGNIQIVRKNIPE

NIYQELYKYFNDKSDKELSDEAAKLKNVVGHHEAATNIVKDYRYTYDKYFLHMPITINFK

ANKTGFINDRILQYIAKEKDLHVIGIDRGERNLIYVSVIDTCGNIVEQKSFNIVNGYDYQ

IKLKQQEGARQIARKEWKEIGKIKEIKEGYLSLVIHEISKMVIKYNAIIAMEDLSYGFKK

GRFKVERQVYQKFETMLINKLNYLVFKDISITENGGLLKGYQLTYIPDKLKNVGHQCGCI

FYVPAAYTSKIDPTTGFVNIFKFKDLTVDAKREFIKKFDSIRYDSEKNLFCFTFDYNNFI

TQNTVMSKSSWSVYTYGVRIKRRFVNGRFSNESDTIDITKDMEKTLEMTDINWRDGHDLR

QDIIDYEIVQHIFEIFRLTVQMRNSLSELEDRDYDRLISPVLNENNIFYDSAKAGDALPK

DADANGAYCIALKGLYEIKQITENWKEDGKFSRDKLKISNKDWFDFIQNKRYL

SEQ ID NO: 111

GHHHHHHSSGVDLGTENLYFQSMSRRRKANPTKLSENAKKLAKEVENASGSGAGSKRPAA

TKKAGQAKKKKASGSGAGSPAAKKKKLDGSVDASGSGAGSPKKKRKVEDASGSGAGSPKK

KRKVASGSGAGSMNNGTNNFQNFIGISSLQKTLRNALIPTETTQQFIVKNGIIKEDELRG

ENRQILKDIMDDYYRGFISETLSSIDDIDWTSLFEKMEIQLKNGDNKDTLIKEQTEYRKA

IHKKFANDDRFKNMFSAKLISDILPEFVIHNNNYSASEKEEKTQVIKLFSRFATSFKDYF

-continued

KNRANCFSADDISSSSCHRIVNDNAEIFFSNALVYRRIVKSLSNDDINKISGDMKDSLKE

MSLEEIYSYEKYGEFITQEGISFYNDICGKVNSFMNLYCQKNKENKNLYKLQKLHKQILC

IADTSYEVPYKFESDEEVYQSVNGFLDNISSKHIVERLRKIGDNYNGYNLDKIYIVSKFY

ESVSQKTYRDWETINTALEIHYNNILPGNGKSKADKVKKAVKNDLQKSITEINELVSNYK

LCSDDNIKAETYIHEISHILNNFEAQELKYNPEIHLVESELKASELKNVLDVIMNAFHWC

SVFMTEELVDKDNNFYAELEEIYDEIYPVISLYNLVRNYVTQKPYSTKKIKLNFGIPTLA

DGWSKSKEYSNNAIILMRDNLYYLGIFNAKNKPDKKIIEGNTSENKGDYKKMIYNLLPGP

NKMIPKVFLSSKTGVETYKPSAYILEGYKQNKHIKSSKDFDITFCHDLIDYFKNCIAIHP

EWKNFGFDFSDTSTYEDISGFYREVELQGYKIDWTYISEKDIDLLQEKGQLYLFQIYNKD

FSKKSTGNDNLHTMYLKNLFSEENLKDIVLKLNGEAEIFFRKSSIKNPIIHKKGSILVNR

TYEAEEKDQFGNIQIVRKNIPENIYQELYKYFNDKSDKELSDEAAKLKNVVGHHEAATNI

VKDYRYTYDKYFLHMPITINFKANKTGFINDRILQYIAKEKDLHVIGIDRGERNLIYVSV

IDTCGNIVEQKSFNIVNGYDYQIKLKQQEGARQIARKEWKEIGKIKEIKEGYLSLVIHEI

SKMVIKYNAIIAMEDLSYGFKKGRFKVERQVYQKFETMLINKLNYLVFKDISITENGGLL

KGYQLTYIPDKLKNVGHQCGCIFYVPAAYTSKIDPTTGFVNIFKFKDLTVDAKREFIKKF

DSIRYDSEKNLFCFTFDYNNFITQNTVMSKSSWSVYTYGVRIKRRFVNGRFSNESDTIDI

TKDMEKTLEMTDINWRDGHDLRQDIIDYEIVQHIFEIFRLTVQMRNSLSELEDRDYDRLI

SPVLNENNIFYDSAKAGDALPKDADANGAYCIALKGLYEIKQITENWKEDGKFSRDKLKI

SNKDWFDFIQNKRYL*

SEQ ID NO: 112
MGHHHHHHSSGVDLGTENLYFQSMSRRRKANPTKLSENAKKLAKEVENASGSGAGSKRPA

ATKKAGQAKKKKASGSGAGSPAAKKKKLDGSVDASGSGAGSPKKKRKVEDASGSGAGSPK

KKRKVASGSGAGSMNNGTNNFQNFIGISSLQKTLRNALIPTETTQQFIVKNGIIKEDELR

GENRQILKDIMDDYYRGFISETLSSIDDIDWTSLFEKMEIQLKNGDNKDTLIKEQTEYRK

AIHKKFANDDRFKNMFSAKLISDILPEFVIHNNNYSASEKEEKTQVIKLFSRFATSFKDY

FKNRANCFSADDISSSSCHRIVNDNAEIFFSNALVYRRIVKSLSNDDINKISGDMKDSLK

EMSLEEIYSYEKYGEFITQEGISFYNDICGKVNSFMNLYCQKNKENKNLYKLQKLHKQIL

CIADTSYEVPYKFESDEEVYQSVNGFLDNISSKHIVERLRKIGDNYNGYNLDKIYIVSKF

YESVSQKTYRDWETINTALEIHYNNILPGNGKSKADKVKKAVKNDLQKSITEINELVSNY

KLCSDDNIKAETYIHEISHILNNFEAQELKYNPEIHLVESELKASELKNVLDVIMNAFHW

CSVFMTEELVDKDNNFYAELEEIYDEIYPVISLYNLVRNYVTQKPYSTKKIKLNFGIPTL

ADGWSKSKEYSNNAIILMRDNLYYLGIFNAKNKPDKKIIEGNTSENKGDYKKMIYNLLPG

PNKMIPKVFLSSKTGVETYKPSAYILEGYKQNKHIKSSKDFDITFCHDLIDYFKNCIAIH

PEWKNFGFDFSDTSTYEDISGFYREVELQGYKIDWTYISEKDIDLLQEKGQLYLFQIYNK

DFSKKSTGNDNLHTMYLKNLFSEENLKDIVLKLNGEAEIFFRKSSIKNPIIHKKGSILVN

RTYEAEEKDQFGNIQIVRKNIPENIYQELYKYFNDKSDKELSDEAAKLKNVVGHHEAATN

IVKDYRYTYDKYFLHMPITINFKANKTGFINDRILQYIAKEKDLHVIGIDRGERNLIYVS

VIDTCGNIVEQKSFNIVNGYDYQIKLKQQEGARQIARKEWKEIGKIKEIKEGYLSLVIHE

ISKMVIKYNAIIAMEDLSYGFKKGRFKVERQVYQKFETMLINKLNYLVFKDISITENGGL

LKGYQLTYIPDKLKNVGHQCGCIFYVPAAYTSKIDPTTGFVNIFKFKDLTVDAKREFIKK

FDSIRYDSEKNLFCFTFDYNNFITQNTVMSKSSWSVYTYGVRIKRRFVNGRFSNESDTID

-continued

ITKDMEKTLEMTDINWRDGHDLRQDIIDYEIVQHIFEIFRLTVQMRNSLSELEDRDYDRL

ISPVLNENNIFYDSAKAGDALPKDADANGAYCIALKGLYEIKQITENWKEDGKFSRDKLK

ISNKDWFDFIQNKRYL*

SEQ ID NO: 43
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAATAACGGT

ACCAATAACTTCCAGAACTTCATCGGTATTTCTAGCCTGCAAAAGACCCTGCGTAACGCG

CTGATTCCGACCGAGACTACCCAGCAATTCATCGTGAAAAACGGTATCATTAAGGAAGAT

GAATTGCGCGGTGAGAATCGTCAGATTCTGAAAGATATCATGGATGACTACTATCGCGGT

TTCATTAGCGAAACCCTGTCGAGCATCGATGATATCGATTGGACGAGCCTCTTCGAGAAA

ATGGAAATTCAACTGAAAAATGGTGACAACAAAGATACCCTGATTAAAGAACAAACGGAA

TACCGCAAGGCAATCCATAAAAAGTTTGCGAATGACGACCGTTTTAAGAATATGTTCTCG

GCCAAGCTGATTTCCGACATCCTGCCAGAGTTCGTCATTCACAACAACAATTACAGCGCA

AGCGAGAAAGAGGAAAAGACTCAGGTCATTAAGCTGTTTAGCCGCTTTGCGACGTCCTTC

AAAGACTACTTCAAGAATCGTGCGAATTGCTTTAGCGCGGATGACATCTCTAGCTCTAGC

TGTCACCGTATTGTTAACGACAATGCAGAGATTTTCTTCAGCAACGCCCTGGTGTATCGC

CGTATTGTCAAGTCTCTGAGCAACGACGACATTAACAAGATCAGCGGCGACATGAAAGAC

AGCCTGAAAGAAATGTCTCTGGAAGAAATCTACAGCTACGAGAAATATGGTGAGTTTATC

ACCCAAGAGGGCATTAGCTTCTACAATGATATCTGTGGTAAGGTTAATAGCTTTATGAAT

CTGTACTGCCAGAAGAATAAAGAAAACAAGAACTTGTACAAGCTGCAAAAGCTGCATAAG

CAAATTCTGTGCATCGCCGATACTAGCTATGAAGTTCCGTACAAGTTCGAGTCTGATGAA

GAGGTGTATCAGTCAGTCAACGGTTTTCTGGATAACATCAGCAGCAAGCACATCGTCGAG

CGCCTGCGCAAGATTGGTGACAACTACAATGGTTATAACCTGGACAAGATCTATATCGTG

TCGAAGTTTTACGAGAGCGTGTCCCAGAAAACGTACCGTGATTGGGAAACGATTAACACG

GCCTTGGAAATTCACTATAACAATATCCTGCCGGGCAACGGCAAGAGCAAAGCTGACAAA

GTCAAAAAAGCTGTGAAAAACGATCTGCAAAAGTCCATCACCGAGATCAACGAACTGGTT

AGCAACTATAAGCTGTGTAGCGACGACAACATTAAAGCTGAAACGTATATCCACGAAATC

AGCCACATCCTGAATAACTTTGAGGCACAAGAACTGAAATACAATCCTGAGATCCATCTG

GTAGAGAGCGAGCTGAAGGCAAGCGAGTTGAAAAACGTTCTCGACGTTATCATGAATGCT

TTCCACTGGTGTAGCGTGTTTATGACCGAAGAACTGGTTGACAAAGATAACAATTTCTAT

GCAGAGCTGGAAGAAATCTATGATGAAATCTACCCGGTCATCAGCCTGTATAACCTGGTT

CGTAACTACGTGACGCAGAAGCCGTACAGCACCAAAAAGATCAAGCTGAACTTCGGTATT

CCGACCTTGGCGGACGGTTGGAGCAAATCCAAAGAATACTCCAATAATGCGATTATTCTG

ATGCGTGATAATCTGTACTATCTGGGTATCTTCAATGCGAAGAACAAGCCAGATAAAAAG

ATTATTGAAGGCAACACCAGCGAGAATAAAGGCGACTACAAGAAAATGATCTACAACTTA

TTGCCGGGTCCGAACAAGATGATCCCGAAAGTTTTTCTGAGCAGCAAGACCGGCGTTGAA

ACCTATAAGCCGAGCGCGTACATTTTAGAGGGCTATAAACAAAACAAGCACATCAAGAGC

AGCAAAGATTTTGATATTACGTTCTGCCACGACCTGATCGACTATTTCAAGAATTGTATT

GCGATTCACCCTGAGTGGAAGAACTTCGGTTTTGACTTTTCCGATACCTCCACCTATGAA

GATATTAGCGGTTTTTACCGTGAAGTCGAGTTGCAGGGTTATAAGATTGATTGGACTTAC

ATTTCCGAGAAAGACATCGACCTGTTGCAAGAGAAAGGTCAGCTGTACCTGTTTCAGATC

-continued

TATAACAAAGATTTCAGCAAAAAGTCGACGGGCAATGATAATCTGCACACCATGTATCTG

AAAAACCTGTTTAGCGAAGAGAACCTGAAAGACATTGTTCTTAAGCTGAATGGTGAGGCC

GAGATCTTCTTCCGTAAAAGCTCCATTAAGAACCCGATTATCCACAAAAAGGGCTCTATT

CTGGTTAACCGCACGTACGAAGCGGAAGAGAAAGATCAATTTGGTAACATCCAGATCGTG

CGTAAGAATATCCCGGAGAACATTTACCAAGAACTGTATAAGTATTTCAATGACAAGAGC

GATAAAGAATTGAGCGATGAAGCGGCAAAGCTGAAAAACGTCGTTGGCCACCACGAAGCC

GCGACGAATATCGTGAAAGATTATCGTTACACCTACGACAAGTACTTTCTGCACATGCCG

ATCACCATCAATTTCAAAGCGAATAAAACGGGTTTTATCAATGACCGTATCCTGCAGTAC

ATTGCGAAAGAAAAAGATTTACACGTGATTGGTATTGATCGCGGCGAGCGCAATCTGATT

TACGTCAGCGTTATCGACACGTGCGGCAATATTGTGGAGCAGAAAAGCTTCAATATCGTC

AATGGTTACGACTACCAGATCAAACTGAAGCAACAAGAGGGCGCCCGCCAGATTGCGCGT

AAAGAGTGGAAAGAAATCGGTAAGATTAAAGAAATCAAGGAAGGCTACCTGTCCCTGGTG

ATCCATGAAATCAGCAAAATGGTGATCAAGTACAACGCTATCATTGCGATGGAAGATCTG

AGCTACGGTTTTAAAAAGGGTCGCTTCAAAGTTGAGCGTCAAGTGTATCAGAAATTTGAG

ACTATGCTGATTAACAAGTTGAACTATCTGGTTTTTAAAGACATCAGCATTACCGAGAAT

GGTGGCCTGCTGAAGGGTTATCAACTGACCTATATTCCTGACAAGTTGAAAAATGTTGGT

CATCAGTGTGGTTGCATTTTTCTACGTACCGGCAGCGTACACGAGCAAGATTGACCCGACC

ACGGGTTTCGTTAACATTTTCAAGTTTAAAGATTTGACCGTGGACGCCAAGCGTGAGTTC

ATTAAAAAGTTCGACAGCATCAGATACGACTCTGAGAAGAATCTGTTCTGCTTTACGTTC

GACTACAATAACTTCATTACCCAAAATACCGTTATGAGCAAAAGCTCCTGGAGCGTGTAC

ACGTACGGCGTCCGTATCAAGCGTCGTTTTGTGAATGGTCGCTTTTCCAACGAATCTGAC

ACCATTGACATTACCAAAGATATGGAAAAGACCCTTGAGATGACCGACATTAATTGGCGT

GATGGCCATGACTTGCGCCAAGACATTATCGACTACGAAATTGTTCAGCACATCTTTGAG

ATTTTTCGTCTGACGGTCCAGATGCGCAACTCGCTGAGCGAGTTGGAAGATCGTGACTAT

GACCGTCTGATTAGCCCGGTGCTGAATGAAAACAATATCTTCTATGATAGCGCAAAGGCC

GGTGACGCGCTGCCGAAAGATGCGGATGCTAACGGTGCATACTGCATTGCACTGAAGGGT

CTGTACGAAATCAAACAGATCACCGAGAATTGGAAAGAGGATGGTAAGTTTAGCCGTGAT

AAGCTGAAGATTAGCAATAAAGACTGGTTCGACTTTATTCAAAACAAGCGCTATCTGAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 44
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAACAACGGA

ACAAATAATTTTCAGAACTTTATTGGGATCAGTTCGCTTCAGAAAACGCTTCGTAATGCT

CTGATTCCCACAGAAACCACTCAGCAGTTTATCGTAAAGAATGGCATTATCAAGGAGGAT

GAATTACGCGGCGAGAACCGCCAAATCTTAAAAGATATCATGGACGACTACTACCGCGGT

TTCATTAGCGAAACTCTTAGTTCAATTGACGACATTGACTGGACGTCCTTGTTCGAAAAG

ATGGAGATTCAATTAAAGAACGGTGATAACAAGGATACGTTGATTAAAGAACAGACGGAG

TACCGTAAGGCTATCCACAAAAAATTTGCAAACGACGACCGCTTTAAAAATATGTTTAGC

GCAAAATTAATCTCCGACATCCTGCCTGAATTCGTCATCCATAACAATAACTATAGCGCC

-continued

TCGGAAAAAGAAGAAAAAACGCAGGTTATTAAACTTTTCTCGCGCTTTGCAACAAGCTTT

AAGGATTACTTCAAAAATCGCGCCAATTGTTTTTCAGCCGACGACATTAGCTCCAGTTCC

TGCCACCGTATTGTGAATGACAACGCTGAGATTTTTTTTTCCAATGCGCTGGTTTATCGT

CGTATTGTTAAGAGCCTTAGTAACGACGACATTAATAAAATTAGCGGTGATATGAAGGAT

AGCTTGAAAGAAATGAGTCTGGAAGAGATCTATAGTTACGAGAAGTACGGCGAATTTATT

ACCCAGGAGGGCATTTCATTTTACAATGATATCTGTGGAAAAGTCAACTCCTTTATGAAC

TTGTATTGCCAAAAGAATAAAGAAAACAAAAACCTGTACAAACTGCAAAAGTTACACAAG

CAGATTTTGTGTATCGCAGACACGTCATACGAAGTACCGTACAAGTTTGAGTCCGATGAA

GAAGTGTACCAAAGCGTTAATGGCTTTTTGGATAACATTTCGAGCAAACATATCGTAGAG

CGTTTGCGTAAGATTGGTGATAATTACAACGGTTACAATTTAGACAAAATCTATATCGTC

TCTAAGTTTTACGAAAGTGTTTCTCAGAAAACTTACCGCGATTGGGAGACGATCAACACT

GCGCTGGAGATTCATTACAATAATATCCTTCCAGGTAACGGTAAAAGCAAAGCTGATAAG

GTGAAAAAGGCGGTTAAAAATGACCTTCAAAAGTCTATCACAGAAATCAACGAATTGGTC

AGCAATTATAAGCTTTGCAGTGACGATAACATTAAGGCCGAGACTTACATCCATGAGATC

TCTCACATTCTTAATAATTTTGAAGCGCAAGAGCTGAAATACAATCCTGAAATCCATCTG

GTCGAAAGTGAATTAAAAGCCTCCGAATTAAAAAATGTCTTGGACGTGATCATGAATGCG

TTCCATTGGTGCTCAGTTTTTATGACGGAAGAGTTGGTGGACAAAGACAACAATTTTTAC

GCCGAGCTTGAGGAAATTTACGACGAAATTTACCCCGTTATTTCGTTATACAACCTTGTG

CGTAATTACGTTACACAAAAGCCCTATTCGACAAAGAAAATCAAGTTAAATTTCGGGATT

CCCACATTAGCTGATGGATGGTCCAAATCCAAAGAATACTCGAATAACGCTATCATCCTT

ATGCGTGATAATTTGTACTACTTAGGCATCTTCAATGCGAAGAACAAACCTGACAAGAAA

ATTATCGAAGGAAACACTTCGGAGAACAAAGGTGATTATAAAAAGATGATCTACAACTTG

CTTCCCGGGCCAAACAAAATGATTCCCAAGGTATTTTTGAGTTCTAAAACCGGTGTCGAA

ACTTACAAACCAAGTGCTTATATTTTGGAAGGATACAAACAGAACAAACATATCAAGTCT

TCGAAAGACTTCGATATTACGTTCTGCCACGATCTGATCGATTACTTCAAGAACTGTATT

GCTATTCACCCCGAGTGGAAGAACTTTGGATTTGATTTCTCCGACACGTCCACTTATGAA

GATATCTCTGGCTTCTATCGCGAGGTTGAATTACAAGGGTATAAGATTGACTGGACTTAT

ATTTCGGAGAAGGATATCGATCTTTTGCAAGAAAAAGGGCAACTTTATTTATTTCAGATC

TATAACAAGGACTTTTCAAAAAAGAGCACTGGAAATGACAATCTGCATACCATGTACCTT

AAGAACCTGTTCTCGGAAGAGAACCTGAAGGACATTGTACTTAAACTGAATGGAGAGGCA

GAGATCTTCTTTCGCAAATCAAGCATTAAGAACCCAATTATTCACAAAAAGGGGAGTATC

TTAGTAAATCGCACATATGAGGCTGAGGAAAAAGATCAGTTTGGTAACATTCAGATCGTG

CGTAAGAACATTCCTGAAAATATCTATCAGGAACTTTATAAGTATTTCAACGATAAAAGT

GATAAAGAGCTGAGTGACGAAGCGGCTAAACTTAAGAATGTTGTGGGACACCATGAGGCA

GCAACCAATATTGTGAAGGATTATCGCTATACGTACGACAAATACTTTTTACACATGCCC

ATCACTATTAATTTTAAAGCTAATAAGACTGGCTTCATTAACGATCGCATCCTGCAGTAC

ATTGCTAAGGAAAAGGATCTTCACGTTATCGGTATCGATCGCGGGGAGCGTAATCTTATC

TACGTCTCTGTCATTGACACGTGTGGCAATATTGTGGAGCAAAAGTCCTTCAATATTGTT

AACGGCTATGACTATCAGATTAAATTGAAACAGCAGGAAGGTGCGCGTCAGATTGCCCGC

AAGGAATGGAAGGAAATTGGCAAGATCAAAGAAATTAAGGAGGGCTACTTAAGCTTAGTA

-continued

ATTCACGAAATTAGTAAAATGGTTATCAAATACAACGCCATCATCGCGATGGAGGATCTT

TCGTACGGGTTTAAGAAAGGTCGTTTTAAAGTGGAGCGTCAGGTGTACCAGAAATTTGAA

ACTATGCTTATTAACAAACTTAACTACCTGGTTTTCAAGGATATCAGTATTACTGAAAAC

GGGGGGCTGTTAAAAGGGTATCAATTAACTTACATTCCAGACAAATTAAAGAACGTTGGA

CATCAGTGTGGCTGCATTTTTTATGTACCAGCTGCATACACTTCAAAGATCGATCCTACG

ACTGGGTTCGTGAACATTTTTAAGTTTAAAGACTTGACGGTAGATGCCAAGCGCGAATTC

ATCAAGAAATTCGACAGCATTCGCTACGACTCTGAGAAAAATCTTTTCTGTTTCACATTC

GATTATAACAATTTCATTACGCAGAACACAGTAATGTCCAAGTCTTCTTGGAGTGTTTAT

ACATATGGTGTCCGCATTAAGCGCCGTTTCGTCAACGGCCGCTTCAGTAATGAGAGCGAT

ACTATTGACATCACAAAAGACATGGAAAAAACACTGGAAATGACCGACATCAATTGGCGT

GACGGCCATGACTTACGTCAGGATATCATTGATTATGAGATCGTTCAACACATCTTCGAA

ATCTTTCGCTTGACTGTTCAAATGCGCAATTCCTTGTCGGAATTGGAGGACCGTGATTAT

GACCGCTTAATTTCCCCCGTCTTAAATGAAAACAATATTTTTTATGACTCTGCAAAAGCT

GGAGATGCTCTGCCGAAAGACGCCGATGCAAATGGGGCATATTGCATTGCTTTAAAGGGG

CTTTACGAGATCAAGCAAATCACCGAAAACTGGAAAGAGGATGGAAAGTTTTCGCGTGAT

AAACTGAAGATCTCTAACAAAGACTGGTTCGACTTTATCCAGAACAAGCGTTATTTGAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 45

ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAACAACGGC

ACCAATAACTTCCAAAACTTCATCGGGATCTCTAGCCTTCAGAAGACGCTTCGCAATGCT

CTTATCCCAACTGAGACCACTCAACAATTTATTGTGAAGAATGGAATTATTAAAGAGGAC

GAACTGCGTGGCGAGAATCGTCAGATCTTAAAGGACATTATGGATGATTATTACCGTGGA

TTCATCTCCGAAACATTATCGTCGATCGATGATATCGATTGGACTTCTCTGTTCGAGAAA

ATGGAAATTCAATTGAAAAACGGAGATAATAAAGATACGCTTATCAAAGAACAGACGGAA

TATCGTAAAGCGATTCATAAGAAATTCGCAAATGACGATCGTTTCAAAAATATGTTCAGT

GCCAAGCTTATTTCGGACATTTTACCTGAATTTGTAATTCATAATAATAACTACTCAGCA

AGTGAGAAGGAGGAGAAAACCCAAGTTATTAAACTGTTCTCTCGTTTCGCAACGTCCTTT

AAAGATTACTTTAAAAACCGCGCGAATTGCTTTAGCGCTGACGACATTTCCAGCTCATCC

TGTCATCGCATCGTAAACGACAATGCGGAAATCTTCTTCAGCAACGCCCTGGTTTACCGC

CGCATCGTCAAAAGCTTATCGAATGACGACATCAATAAGATCTCAGGAGATATGAAGGAC

TCGCTTAAGGAGATGTCTCTGGAGGAAATTTATAGTTACGAAAAGTATGGAGAGTTCATT

ACCCAGGAGGGAATCTCGTTCTACAATGACATTTGCGGGAAGGTGAACTCCTTCATGAAC

TTATACTGCCAGAAAAACAAAGAGAACAAAAATCTGTATAAATTGCAGAAATTACATAAA

CAGATTCTTTGTATTGCTGACACTTCCTACGAAGTACCCTATAAATTCGAGTCAGATGAA

GAAGTATACCAGTCCGTGAACGGATTTCTGGACAATATCTCCTCAAAACACATCGTGGAA

CGCTTACGTAAAATTGGCGATAATTATAATGGTTACAATCTTGACAAAATTTATATCGTA

TCTAAATTTTACGAGAGTGTGAGCCAAAAGACCTACCGCGACTGGGAGACCATCAACACA

GCTTTAGAAATTCACTATAATAATATCTTACCCGGCAATGGTAAGAGCAAGGCTGACAAG

-continued

GTAAAAAAGGCCGTCAAGAATGATTTGCAGAAATCTATTACAGAAATTAATGAGTTAGTC

TCCAACTATAAGCTTTGTTCCGACGATAACATCAAAGCTGAGACATATATTCATGAGATT

AGTCACATTCTTAACAACTTCGAGGCCCAGGAACTTAAGTACAATCCTGAAATTCATCTT

GTCGAGTCTGAGCTGAAAGCTAGTGAATTGAAAAATGTTTTAGACGTTATTATGAACGCA

TTCCACTGGTGCTCTGTGTTTATGACAGAAGAACTGGTCGACAAGGACAATAACTTCTAT

GCCGAACTTGAGGAAATCTACGATGAAATTTACCCTGTAATCTCCTTGTATAATCTTGTA

CGTAATTACGTCACTCAAAAACCTTACAGCACGAAAAAAATTAAATTGAACTTCGGGATT

CCTACACTTGCCGACGGGTGGTCTAAATCCAAGGAATATAGCAACAATGCCATTATTTTA

ATGCGCGACAATCTTTACTATTTAGGAATTTTTAACGCTAAGAACAAGCCCGATAAAAAG

ATTATTGAAGGAAACACGTCTGAAAATAAGGGCGACTACAAAAAGATGATTTATAACCTT

TTGCCCGGTCCAAACAAAATGATCCCAAAGGTATTCCTGTCATCCAAAACAGGGGTTGAG

ACATATAAGCCCAGCGCATATATTCTGGAAGGATACAAACAGAATAAACATATCAAAAGC

AGCAAAGATTTTGACATTACTTTTTGCCACGATTTAATCGACTACTTCAAAAACTGTATC

GCTATCCACCCTGAATGGAAGAATTTCGGATTTGATTTCTCAGATACAAGTACGTATGAG

GATATCAGCGGTTTCTATCGCGAAGTTGAACTTCAAGGGTATAAAATTGACTGGACCTAC

ATTAGTGAGAAGGACATCGACCTGTTACAGGAAAAAGGCCAATTGTACTTGTTTCAGATC

TACAATAAGGATTTCTCAAAAAAATCGACCGGCAATGATAACTTGCACACCATGTACCTG

AAGAACCTTTTTTCGGAGGAAAACCTTAAAGACATTGTCCTGAAGTTGAATGGAGAAGCG

GAGATTTTCTTTCGTAAGTCTTCCATTAAAAATCCAATTATTCATAAGAAGGGCAGCATC

CTTGTGAACCGTACGTACGAGGCGGAAGAGAAGGACCAATTCGGTAACATTCAAATCGTC

CGCAAGAACATCCCTGAAAATATTTATCAGGAGCTTTACAAGTATTTCAATGATAAGTCC

GACAAGGAATTATCAGATGAGGCTGCGAAGTTGAAAAATGTTGTTGGTCATCACGAGGCG

GCGACGAATATTGTAAAGGATTATCGCTACACTTATGACAAGTACTTTCTGCACATGCCG

ATCACCATTAATTTCAAGGCGAACAAAACAGGATTTATTAATGACCGCATCTTACAATAC

ATTGCCAAAGAAAAGGACTTACACGTTATTGGCATTGATCGTGGAGAACGCAACTTAATC

TACGTAAGCGTTATTGACACTTGCGGGAATATCGTAGAACAAAAGAGCTTCAACATCGTG

AATGGTTACGATTACCAGATCAAGCTTAAGCAGCAGGAGGGAGCGCGCCAGATCGCGCGC

AAGGAATGGAAGGAGATTGGTAAGATCAAGGAAATCAAGGAAGGTTATCTGTCCTTGGTA

ATCCACGAAATTTCGAAAATGGTTATCAAATACAATGCTATTATTGCAATGGAGGACTTG

TCCTACGGCTTTAAAAAAGGACGCTTTAAGGTGGAGCGCCAGGTTTATCAAAAGTTTGAA

ACAATGCTGATTAACAAGCTGAACTATTTGGTCTTTAAAGATATCTCCATCACCGAAAAT

GGTGGGCTTTTGAAAGGCTATCAACTTACATATATCCCTGATAAGCTTAAGAATGTGGGT

CATCAGTGCGGGTGCATTTTTTATGTTCCTGCAGCCTACACGTCCAAAATCGATCCTACA

ACTGGATTTGTTAATATCTTCAAATTTAAGGATCTTACCGTCGACGCGAAGCGCGAATTT

ATCAAGAAATTCGATAGTATTCGTTATGATTCCGAAAAAAACCTTTTCTGTTTCACCTTT

GATTATAATAACTTTATCACGCAAAATACTGTCATGAGCAAATCGAGTTGGTCTGTGTAC

ACTTACGGAGTACGCATCAAGCGTCGTTTTGTTAATGGGCGCTTCAGTAACGAGTCAGAC

ACGATTGATATCACAAAAGATATGGAGAAAACGCTGGAGATGACAGACATCAATTGGCGC

GATGGTCATGACTTACGTCAAGACATTATCGATTATGAAATTGTCCAGCATATCTTTGAG

ATCTTTCGTTTGACTGTTCAGATGCGCAACAGCCTGTCAGAATTGGAGGATCGTGACTAT

GATCGCCTTATTTCTCCCGTCTTAAATGAGAACAATATCTTCTACGACTCAGCCAAGGCT

-continued

GGAGATGCACTGCCAAAAGACGCCGACGCAAATGGGGCCTACTGTATTGCATTGAAGGGG

TTGTACGAGATCAAACAGATTACAGAAAATTGGAAGGAGGACGGTAAGTTCTCTCGTGAT

AAGCTGAAGATTTCTAACAAAGACTGGTTCGATTTCATTCAGAACAAACGTTACCTGAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 46
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAACAACGGT

ACCAATAACTTTCAGAATTTCATTGGAATCAGCAGCTTACAGAAAACCCTGCGCAATGCA

CTTATCCCCACTGAGACAACCCAGCAGTTCATTGTAAAGAACGGGATTATTAAAGAAGAT

GAGCTTCGCGGGGAGAATCGTCAGATCTTAAAGGATATTATGGACGATTACTACCGTGGC

TTCATTTCGGAGACGCTGTCGTCGATCGACGACATCGACTGGACATCCTTGTTTGAAAAG

ATGGAAATCCAACTGAAGAATGGCGATAACAAGGACACGTTAATCAAAGAGCAGACGGAA

TACCGTAAAGCTATCCACAAAAAGTTCGCTAATGACGACCGCTTTAAGAACATGTTCTCA

GCAAAACTTATTAGCGATATTTTACCTGAATTTGTCATCCACAATAACAATTACTCCGCG

AGTGAAAAAGAGGAGAAAACCCAGGTGATTAAGCTGTTTTCCCGTTTTGCAACCAGTTTC

AAGGACTATTTTAAGAATCGTGCTAATTGTTTCTCTGCAGACGACATTTCCTCGTCGTCC

TGCCATCGCATTGTTAATGATAATGCTGAAATCTTTTTTTCAAACGCACTTGTGTATCGT

CGCATTGTCAAAAGCTTAAGTAATGACGATATCAATAAGATCTCAGGAGACATGAAGGAC

TCCCTGAAAGAAATGTCATTGGAAGAAATTTACTCTTATGAAAAGTATGGAGAATTTATT

ACGCAGGAGGGTATCAGCTTCTATAACGACATTTGTGGTAAAGTGAACAGCTTTATGAAT

CTTTATTGTCAAAAGAATAAAGAGAACAAAAATCTGTACAAGCTGCAGAAATTGCATAAA

CAAATTCTGTGCATTGCAGATACTTCGTATGAGGTTCCTTACAAATTCGAGTCGGATGAG

GAGGTGTATCAAAGCGTAAACGGATTTTTGGATAACATTAGTAGTAAGCATATTGTGGAA

CGCCTTCGCAAGATTGGTGACAACTATAACGGATACAACTTAGACAAGATCTATATTGTC

TCGAAGTTTTACGAAAGTGTTTCCCAAAAGACTTATCGCGACTGGGAGACAATCAACACT

GCGCTGGAAATTCACTATAACAATATCTTGCCGGGGAACGGAAAAAGTAAGGCAGATAAG

GTGAAGAAAGCAGTCAAAAATGATCTGCAAAAAAGCATTACTGAAATTAACGAACTTGTG

TCAAATTACAAATTGTGTTCGGATGACAATATTAAAGCGGAAACGTATATCCACGAGATC

TCGCACATTCTTAATAATTTCGAGGCGCAGGAATTAAAGTATAATCCTGAGATCCATTTG

GTGGAATCAGAACTTAAAGCTAGTGAACTGAAAAATGTCCTGGACGTTATTATGAATGCA

TTTCACTGGTGTTCTGTCTTTATGACAGAAGAACTTGTCGACAAAGACAACAACTTTTAT

GCGGAATTAGAAGAGATTTACGACGAAATTTATCCCGTTATTTCGTTATATAATTTAGTT

CGTAATTACGTGACTCAGAAACCCTACAGCACAAAAAAGATTAAATTAAACTTTGGGATT

CCGACTCTTGCTGATGGATGGAGCAAGTCCAAGGAGTACTCTAATAACGCCATTATCTTG

ATGCGTGACAACCTGTACTACCTGGGCATTTTTAACGCTAAAAACAAACCCGACAAAAAG

ATCATTGAAGGGAACACCTCGGAAAATAAGGGGGACTATAAAAAAATGATCTACAATCTG

TTGCCAGGCCCAAATAAGATGATCCCAAAGGTTTTTTTATCTTCCAAAACTGGCGTAGAA

ACTTACAAGCCGAGCGCATACATCCTTGAAGGATATAAACAAAACAAACATATCAAAAGT

TCAAAGGACTTCGATATTACGTTCTGCCATGATTTAATCGATTATTTCAAGAATTGCATC

-continued

GCGATTCACCCAGAGTGGAAAAACTTTGGGTTTGATTTTTCAGACACCAGCACTTACGAG

GATATTAGTGGATTCTATCGTGAGGTTGAACTGCAGGGCTATAAAATTGACTGGACCTAT

ATTTCTGAAAAAGATATTGATCTGCTTCAGGAGAAAGGCCAATTGTACTTATTTCAAATC

TATAACAAGGATTTCTCCAAGAAGTCCACGGGTAATGACAACTTACACACAATGTATCTG

AAGAATCTGTTTAGTGAGGAGAACTTGAAGGACATTGTGCTGAAGCTTAATGGCGAGGCC

GAAATCTTTTTTCGTAAGTCCTCCATTAAAAACCCTATTATCCATAAGAAAGGGAGTATT

CTTGTCAACCGCACGTATGAGGCCGAAGAAAAGGACCAATTCGGAAACATCCAAATTGTC

CGTAAAAATATTCCTGAGAACATTTACCAGGAGCTTTACAAGTATTTCAACGACAAGAGT

GATAAAGAACTTTCAGATGAGGCGGCGAAACTGAAGAATGTAGTGGGGCACCACGAAGCT

GCCACGAATATTGTAAAGGATTACCGTTACACCTACGACAAGTACTTTTTGCATATGCCC

ATCACAATTAATTTTAAGGCCAATAAAACTGGTTTTATCAACGATCGTATCTTACAGTAC

ATTGCTAAGGAAAAAGATCTGCACGTTATCGGTATCGATCGCGGGGAACGCAATCTGATT

TATGTTAGTGTGATTGACACGTGCGGAAATATTGTTGAGCAGAAGAGCTTTAATATCGTA

AATGGATATGACTATCAAATTAAACTGAAGCAACAGGAAGGGGCCCGCCAGATTGCCCGC

AAGGAGTGGAAAG1AAATTGGAAAGATCAAGGAGATTAAAGAAGGGTACCTTTCCCTTGT

TATCCACGAAATCTCGAAAATGGTGATCAAGTACAATGCCATTATTGCTATGGAGGATCT

GTCATATGGGTTTAAGAAAGGCCGCTTTAAGGTGGAACGTCAGGTTTACCAGAAGTTTGA

GACCATGCTTATCAATAAGCTGAATTATCTTGTCTTCAAAGACATCTCAATCACAGAGAA

CGGCGGGCTGTTAAAAGGATATCAGCTGACCTATATCCCCGACAAACTGAAAAATGTCGG

GCACCAATGCGGCTGTATTTTCTACGTGCCCGCTGCATACACATCTAAAATTGACCCAAC

GACTGGATTCGTAAATATTTTTAAGTTTAAGGATCTTACGGTAGATGCAAAGCGCGAATT

TATCAAGAAATTTGATAGTATCCGTTACGACAGCGAGAAAAACTTATTTTGTTTTACGTT

CGATTATAACAACTTCATCACGCAAAATACCGTCATGTCAAAATCTTCCTGGTCAGTCTA

TACGTATGGCGTCCGTATCAAGCGCCGCTTCGTCAACGGGCGTTTTTCAAACGAGTCAGA

TACCATCGATATCACCAAAGATATGGAAAAAACATTGGAGATGACGGACATCAATTGGCG

CGATGGTCATGACTTACGCCAGGACATTATTGACTACGAAATCGTACAACATATTTTTGA

GATTTTCCGTCTGACCGTGCAAATGCGCAACTCATTATCCGAACTTGAGGATCGTGATTA

CGACCGCTTGATCAGTCCTGTTCTGAACGAGAATAATATTTTTTACGACAGTGCCAAGGC

GGGAGACGCACTGCCCAAGGACGCTGACGCTAACGGAGCTTATTGTATTGCGTTGAAGGG

ACTTTACGAAATCAAGCAAATCACTGAAAACTGGAAGGAGGATGGTAAATTCTCACGCGA

CAAGTTGAAAATTTCGAACAAGGACTGGTTCGATTTCATCCAAAACAAGCGTTATTTAAA

ACGTCCGGCAGCGACCAAAAAAGCCGGCCAGGCGAAGAAAAAAAAAGCGTCAGGTAGCGG

CGCAGGCAGCCCGAAAAAGAAACGTAAAGTCGAGGATCCGAAAAAGAAACGTAAGGTTAT

TCCGGGCTAA

SEQ ID NO: 47
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAACAACGGG

ACTAATAACTTCCAGAACTTCATCGGTATTTCATCATTACAAAAAACGCTTCGTAACGCC

TTGATCCCAACAGAAACGACCCAACAATTTATTGTAAAAAACGGCATCATCAAAGAAGAC

GAACTGCGTGGCGAAAATCGCCAAATTTTGAAGGACATTATGGATGACTATTATCGTGGG

TTTATCTCGGAGACATTATCCTCCATCGACGACATTGATTGGACGAGTCTTTTTGAGAAA

ATGGAGATCCAGCTTAAAAATGGTGATAACAAGGATACATTGATCAAGGAGCAAACCGAG

TACCGCAAGGCCATCCATAAGAAGTTCGCAAATGACGACCGCTTCAAAAATATGTTTAGT

GCCAAATTGATCTCGGATATCCTTCCTGAGTTCGTAATTCACAACAATAATTATAGCGCA

TCCGAAAAGGAGGAAAAGACTCAAGTCATTAAGCTTTTCAGTCGCTTTGCTACCTCGTTT

AAGGACTATTTCAAGAACCGCGCGAACTGCTTCTCAGCGGATGACATTTCTTCCTCGTCG

TGTCACCGCATCGTGAATGATAATGCGGAGATCTTCTTTAGTAATGCCTTGGTATACCGC

CGCATTGTTAAATCCCTGTCTAACGACGATATCAATAAGATCTCAGGAGATATGAAGGAT

AGCCTTAAAGAAATGTCTCTGGAAGAAATTTACTCCTATGAAAAGTACGGTGAGTTTATC

ACCCAAGAGGGGATTAGCTTTTATAACGATATCTGCGGGAAGGTGAATTCGTTTATGAAC

CTTTATTGTCAAAAGAATAAGGAGAATAAGAACTTATATAAGCTTCAGAAACTGCATAAA

CAAATCTTATGCATTGCCGATACTAGCTATGAAGTTCCGTATAAATTCGAGAGCGATGAA

GAAGTTTATCAGAGCGTCAATGGGTTCTTGGATAACATTTCATCAAAACACATCGTGGAA

CGTCTGCGTAAGATTGGGGATAACTACAACGGATATAATCTTGACAAAATTTATATTGTA

TCTAAATTCTATGAGTCGGTGAGTCAAAAGACCTACCGTGATTGGGAAACAATCAATACC

GCGTTAGAAATCCACTATAACAACATTCTGCCAGGGAATGGTAAAAGTAAAGCGGACAAA

GTCAAGAAGGCTGTGAAGAACGATCTGCAAAAGAGTATTACAGAGATTAACGAATTAGTC

TCCAATTATAAGTTATGCTCGGACGATAACATTAAGGCGGAGACGTATATTCATGAGATT

TCGCATATTCTTAACAACTTCGAGGCACAAGAGCTTAAGTATAACCCAGAGATTCACCTT

GTCGAATCGGAGCTGAAGGCATCGGAATTAAAAAATGTCTTAGATGTAATCATGAACGCG

TTCCATTGGTGCAGTGTTTTCATGACTGAGGAGTTAGTTGACAAGGACAATAACTTCTAC

GCAGAATTAGAAGAGATCTATGATGAGATTTATCCAGTGATTTCGCTGTATAATCTGGTA

CGTAATTACGTCACTCAAAAGCCCTACTCAACAAAAAAAATTAAGCTGAACTTCGGAATT

CCGACTCTGGCCGACGGGTGGTCCAAGTCAAAGGAGTATTCTAATAATGCTATCATCCTG

ATGCGCGATAACTTATACTATTTGGGAATTTTCAATGCCAAAAATAAACCAGATAAAAAG

ATTATCGAAGGTAATACAAGCGAGAATAAGGGTGACTATAAGAAAATGATTTACAATCTT

CTTCCAGGCCCTAACAAGATGATTCCCAAAGTTTTTTTGTCCAGTAAAACAGGGGTCGAA

ACTTACAAGCCCAGTGCCTATATCCTTGAAGGGTACAAGCAGAATAAGCACATCAAATCC

TCGAAAGACTTTGATATTACATTTTGTCATGACTTAATCGATTATTTTAAGAACTGTATC

GCAATCCATCCAGAATGGAAGAACTTCGGGTTTGATTTCTCTGATACTTCCACGTATGAG

GATATTTCCGGGTTCTACCGCGAAGTAGAGCTTCAGGGCTATAAAATTGACTGGACATAT

ATTTCAGAAAAAGACATCGATCTGTTACAAGAAAAAGGACAGTTGTATCTGTTTCAAATC

TATAATAAGGATTTCTCCAAAAAGTCAACTGGAAATGATAACTTACATACAATGTATCTG

AAAAATCTTTTTAGTGAAGAGAATTTGAAGGATATCGTGCTGAAGTTAAATGGCGAAGCA

GAGATCTTCTTCCGCAAGTCCTCGATCAAGAATCCTATCATCCACAAGAAAGGTAGTATT

CTGGTTAACCGCACGTACGAGGCCGAGGAAAAAGACCAGTTCGGTAATATCCAGATTGTA

CGTAAGAATATTCCTGAAAATATTTACCAGGAATTATACAAGTATTTTAACGACAAATCG

GATAAGGAGCTTTCAGATGAGGCCGCAAAGTTGAAGAACGTCGTAGGACACCATGAGGCC

GCTACGAATATCGTCAAGGACTACCGCTATACGTATGACAAGTACTTCCTGCACATGCCT

ATTACTATCAATTTCAAAGCTAATAAAACAGGATTCATCAATGATCGTATCCTTCAGTAC

ATTGCCAAAGAAAAAGATCTGCACGTAATCGGAATCGACCGTGGCGAACGTAATCTGATT

-continued

TACGTATCAGTTATCGACACATGTGGTAACATCGTGGAGCAGAAATCTTTTAACATTGTT

AACGGCTATGATTATCAGATTAAGCTTAAACAGCAGGAGGGGGCACGCCAAATCGCTCGT

AAAGAATGGAAGGAGATTGGAAAGATTAAAGAGATTAAAGAGGGGTACCTTTCGCTGGTT

ATTCACGAAATTTCCAAGATGGTGATTAAGTACAATGCAATCATCGCGATGGAAGATCTT

AGTTACGGATTCAAAAAGGGACGCTTCAAAGTTGAGCGTCAGGTCTACCAGAAATTTGAA

ACGATGCTGATTAACAAATTGAATTACTTGGTATTCAAAGATATCTCAATTACTGAAAAT

GGTGGCTTATTAAAGGGTTACCAGCTTACCTATATCCCGGATAAGCTGAAGAACGTGGGC

CATCAATGCGGCTGCATCTTTTACGTCCCTGCCGCATATACCTCTAAAATTGACCCCACC

ACCGGATTCGTAAATATTTTTAAATTCAAGGACCTGACGGTGGACGCCAAGCGCGAATTC

ATCAAAAAATTCGACTCAATCCGCTATGATTCCGAAAAAAATCTTTTCTGCTTTACGTTC

GATTATAATAACTTCATTACCCAAAACACGGTGATGTCAAAATCGTCCTGGAGCGTGTAT

ACTTATGGAGTGCGTATCAAGCGCCGCTTTGTTAATGGGCGCTTCAGTAACGAAAGCGAT

ACCATCGACATTACCAAAGACATGGAGAAGACGCTTGAAATGACGGATATCAATTGGCGT

GACGGACACGATCTTCGTCAGGATATCATCGACTACGAGATTGTGCAACATATCTTTGAG

ATTTTCCGTTTAACTGTTCAAATGCGTAACTCCTTGTCCGAATTGGAAGACCGTGATTAC

GACCGCTTGATTTCACCAGTGCTTAACGAGAATAACATCTTCTACGACTCCGCCAAAGCA

GGCGATGCCCTGCCAAAGGACGCTGATGCAAATGGTGCATACTGTATCGCGTTGAAGGGC

TTATACGAGATTAAGCAAATCACCGAAAATTGGAAAGAGGATGGAAAGTTCAGTCGCGAT

AAGCTGAAGATCTCTAATAAAGATTGGTTTGACTTTATCCAGAACAAACGTTATTTAAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 48

ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAACAACGGT

ACCAATAATTTCCAAAATTTCATCGGAATCTCATCCTTGCAAAAAACCTTGCGCAATGCT

TTGATCCCCACCGAAACCACGCAGCAGTTCATCGTGAAAAACGGCATTATCAAAGAGGAT

GAGTTGCGCGGGGAAAACCGTCAAATTCTTAAGGATATCATGGACGATTACTACCGTGGG

TTTATCAGTGAGACCCTGTCAAGCATTGACGACATTGACTGGACCAGCTTATTTGAGAAG

ATGGAGATTCAATTAAAGAACGGGGACAATAAGGACACGCTTATCAAAGAGCAGACAGAA

TACCGTAAAGCGATTCATAAGAAATTTGCAAATGACGATCGCTTCAAGAACATGTTTTCA

GCAAAATTAATCAGCGACATCCTTCCCGAATTTGTGATTCATAATAACAACTATTCGGCT

AGCGAAAAAGAGGAGAAAACTCAGGTTATTAAGCTTTTCTCGCGTTTTGCCACTTCGTTC

AAAGACTATTTTAAGAATCGCGCAAACTGCTTTTCGGCTGATGATATTTCCAGTTCTAGC

TGCCATCGTATCGTTAACGATAATGCTGAGATTTTCTTCTCTAATGCCCTGGTGTATCGT

CGTATCGTTAAATCTTTGAGCAACGACGATATTAATAAGATTTCAGGCGACATGAAGGAT

TCTTTAAAGGAGATGTCTTTAGAAGAGATTTATTCCTATGAGAAATATGGCGAGTTTATC

ACCCAAGAAGGAATTTCGTTCTACAACGACATCTGTGGCAAAGTGAACAGCTTCATGAAT

TTATACTGCCAAAAGAATAAGGAGAATAAAAATTTATATAAACTGCAGAAACTGCATAAG

CAAATTCTTTGCATTGCAGACACCTCTTATGAAGTTCCTTATAAGTTTGAATCGGACGAG

GAGGTATATCAGAGTGTGAACGGGTTCCTGGACAATATTTCATCCAAGCATATTGTTGAA

-continued

CGTTTACGCAAAATTGGAGACAATTACAATGGGTATAACCTTGACAAAATTTACATCGTG

TCGAAGTTTTACGAATCGGTAAGCCAGAAGACCTATCGTGACTGGGAAACTATCAATACC

GCCTTAGAAATTCATTACAACAATATTCTTCCTGGTAACGGCAAAAGCAAAGCCGATAAG

GTAAAGAAGGCTGTCAAGAACGACCTGCAAAAGTCTATCACAGAGATCAACGAGTTAGTC

TCTAACTACAAATTATGTTCCGACGACAATATTAAAGCCGAAACCTACATCCATGAGATC

TCACACATTCTTAACAATTTTGAGGCCCAGGAGCTGAAATATAACCCAGAAATTCACCTT

GTAGAGAGCGAATTAAAAGCCTCCGAGCTGAAGAACGTTTTGGATGTAATCATGAACGCA

TTTCATTGGTGCAGCGTATTTATGACAGAGGAGTTGGTCGACAAGGACAATAACTTTTAC

GCCGAGCTTGAAGAAATCTACGATGAAATTTACCCGGTAATTAGTTTATATAATTTAGTT

CGCAACTACGTAACTCAGAAACCCTACAGTACCAAGAAGATTAAATTGAACTTTGGGATC

CCGACACTTGCTGACGGTTGGAGTAAATCAAAAGAATACTCCAATAATGCAATTATCCTG

ATGCGCGACAATCTTTACTACTTGGGGATCTTTAACGCAAAGAACAAACCAGATAAGAAA

ATCATCGAGGGCAACACCAGCGAGAATAAAGGCGATTACAAGAAAATGATCTATAATCTT

TTGCCGGGACCGAACAAAATGATCCCAAAGGTTTTCCTGTCGTCGAAAACGGGAGTCGAG

ACATATAAACCATCTGCGTACATCTTGGAAGGTTACAAACAGAATAAGCATATTAAGTCT

AGTAAAGACTTCGACATCACCTTTTGTCATGACCTGATTGATTATTTCAAGAACTGTATT

GCTATCCATCCAGAATGGAAAAACTTCGGATTTGACTTCTCCGATACTAGCACCTACGAA

GACATTTCGGGTTTTTATCGCGAAGTAGAGCTTCAAGGGTACAAAATTGATTGGACATAT

ATTAGCGAGAAAGACATTGATTTGCTTCAAGAGAAGGGACAGTTATATTTATTCCAGATC

TACAACAAAGACTTCTCGAAGAAATCCACCGGTAATGATAATCTTCACACTATGTACCTG

AAGAATTTATTTTCAGAGGAAAATCTGAAGGACATTGTACTTAAACTTAATGGAGAAGCC

GAAATCTTCTTCCGCAAGAGTTCCATTAAAAATCCGATTATTCATAAAAAGGGAAGTATC

CTTGTGAACCGCACGTATGAGGCCGAAGAGAAGGATCAGTTTGGGAATATTCAAATTGTC

CGCAAAAACATCCCCGAGAACATCTACCAGGAACTGTATAAATACTTTAATGATAAATCT

GATAAAGAGTTATCAGACGAGGCTGCCAAACTGAAAAACGTAGTCGGTCATCATGAGGCA

GCGACCAATATTGTAAAGGACTACCGTTACACCTACGACAAGTATTTCCTTCACATGCCG

ATCACGATTAATTTTAAGGCTAACAAGACCGGCTTTATCAATGACCGCATCTTGCAGTAC

ATCGCGAAAGAGAAAGATTTACACGTCATCGGAATTGATCGTGGAGAGCGTAATCTTATC

TACGTCAGCGTCATCGACACCTGTGGAAACATTGTGGAACAAAAAAGTTTTAATATCGTA

AACGGCTACGACTATCAAATTAAACTTAAACAGCAAGAGGGAGCTCGCCAGATCGCTCGC

AAAGAGTGGAAAGAGATTGGGAAAATTAAAGAAATTAAAGAGGGTTACCTGTCGCTGGTA

ATTCACGAAATCTCGAAAATGGTCATCAAATATAATGCAATTATCGCTATGGAGGATCTG

TCCTACGGGTTCAAGAAGGGACGTTTTAAAGTAGAGCGCCAGGTGTATCAAAAATTCGAA

ACCATGTTGATCAATAAGCTTAACTATTTGGTCTTCAAAGATATTTCGATTACGGAGAAC

GGAGGTTTGTTGAAAGGATATCAGCTGACGTATATCCCAGACAAGTTGAAAAACGTGGGG

CATCAATGTGGATGTATTTTCTATGTGCCCGCGGCCTACACGAGTAAGATCGATCCTACC

ACTGGTTTCGTCAACATTTTCAAATTTAAAGATCTTACCGTGGATGCGAAGCGCGAATTT

ATTAAGAAATTTGATAGCATTCGCTATGATTCCGAAAAGAACCTGTTCTGTTTTACGTTC

GACTATAACAATTTCATTACCCAAAACACGGTGATGAGCAAATCCTCTTGGTCAGTTTAT

ACATACGGTGTACGTATCAAACGCCGTTTCGTTAACGGACGCTTTTCCAATGAGTCTGAT

ACAATCGATATCACGAAAGATATGGAAAAAACATTAGAGATGACTGATATCAACTGGCGT

-continued

GACGGGCACGACCTGCGTCAAGACATTATTGACTACGAGATTGTGCAGCATATCTTCGAA

ATCTTTCGCTTAACTGTGCAAATGCGTAACTCGTTATCCGAGTTAGAAGACCGTGACTAC

GATCGCCTGATTTCACCCGTCTTGAACGAAAATAACATCTTCTACGATTCCGCGAAGGCT

GGGGACGCATTGCCCAAGGACGCAGACGCGAATGGAGCGTACTGTATTGCGCTTAAAGGA

TTATATGAAATCAAGCAGATCACCGAAAATTGGAAGGAGGACGGGAAGTTCTCACGCGAC

AAACTGAAGATTTCAAATAAGGACTGGTTCGATTTCATTCAGAATAAGCGTTACCTGAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 49
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAATAATGGT

ACGAACAACTTTCAGAACTTCATCGGCATCTCCAGCCTTCAAAAGACTTTACGCAACGCA

TTGATTCCCACGGAGACTACGCAACAGTTTATCGTAAAAAATGGTATTATCAAAGAAGAT

GAATTACGCGGGGAGAATCGCCAGATTCTTAAGGACATTATGGACGATTATTACCGTGGA

TTCATCAGTGAGACACTGAGCTCCATTGATGACATCGACTGGACGTCATTGTTTGAAAAG

ATGGAAATCCAGTTGAAAAATGGCGATAACAAAGATACATTGATTAAAGAGCAGACAGAG

TACCGCAAAGCAATTCACAAGAAATTCGCCAATGATGATCGTTTTAAGAACATGTTTAGT

GCCAAGCTTATTTCGGATATCTTACCCGAATTCGTGATTCACAACAACAATTATTCGGCA

AGTGAGAAAGAGGAAAAGACCCAGGTTATCAAATTGTTTTCGCGCTTCGCCACTTCGTTC

AAAGATTATTTCAAGAACCGTGCAAACTGTTTCTCCGCTGACGACATCAGTTCCAGCTCA

TGCCACCGTATTGTAAATGACAATGCGGAGATCTTTTTCAGTAATGCCTTAGTATATCGT

CGCATTGTAAAGAGCTTATCTAATGATGACATTAACAAGATCTCGGGTGATATGAAGGAC

TCACTTAAGGAGATGAGTCTGGAAGAGATCTACTCCTACGAAAAATACGGGGAATTCATC

ACCCAGGAGGGAATTTCATTCTACAACGATATCTGCGGCAAAGTTAACTCCTTTATGAAT

CTGTACTGTCAAAAGAACAAGGAGAATAAAAACCTGTATAAATTGCAGAAACTTCATAAA

CAAATTTTGTGTATCGCAGACACGAGTTATGAAGTACCTTATAAATTCGAATCCGACGAA

GAGGTATATCAGTCCGTAAATGGGTTCCTGGACAATATCAGTAGTAAGCACATTGTGGAA

CGCTTACGCAAAATTGGAGACAATTACAACGGGTATAACCTGGACAAAATCTACATCGTA

TCCAAATTTTATGAAAGCGTGTCTCAAAAAACTTATCGTGATTGGGAAACAATCAACACG

GCTCTTGAGATCCATTACAATAACATCTTGCCGGGTAACGGCAAATCGAAGGCAGACAAA

GTTAAAAAAGCAGTTAAGAACGACTTACAGAAAAGCATTACGGAGATTAACGAGTTAGTA

AGTAATTACAAATTATGCTCCGACGATAATATCAAAGCTGAAACCTACATCCATGAAATT

AGCCACATTTTGAACAATTTCGAAGCGCAGGAGCTGAAATATAACCCTGAAATCCATCTG

GTAGAGTCTGAGTTGAAGGCGTCAGAACTGAAAAACGTTCTTGACGTCATCATGAATGCC

TTTCACTGGTGTAGTGTTTTTATGACTGAGGAGCTTGTAGATAAGGACAACAACTTCTAT

GCTGAACTTGAAGAGATCTACGATGAAATCTACCCCGTAATCAGTCTGTATAATTTAGTT

CGTAACTACGTCACGCAGAAACCCTATTCGACTAAGAAAATTAAGCTGAACTTTGGGATC

CCTACTTTGGCAGACGGGTGGAGCAAGAGTAAAGAATACAGTAATAATGCAATTATCTTG

ATGCGCGATAACTTATATTACTTAGGTATTTTCAATGCTAAGAACAAACCTGATAAGAAG

ATTATCGAAGGAAATACGAGTGAGAATAAGGGAGACTACAAAAAGATGATTTACAACTTG

-continued

CTGCCAGGGCCTAATAAGATGATTCCAAAAGTTTTTCTGTCGAGCAAGACAGGGGTTGAA

ACTTATAAGCCATCCGCTTATATCCTTGAGGGGTACAAGCAGAATAAGCATATCAAGTCC

TCCAAAGATTTTGATATTACATTTTGCCACGACTTAATTGATTACTTCAAGAACTGCATC

GCAATCCATCCCGAATGGAAGAATTTCGGCTTCGATTTCTCAGATACGTCCACGTATGAG

GATATCTCAGGCTTTTACCGCGAAGTTGAGCTGCAAGGTTATAAAATTGATTGGACATAC

ATCTCCGAAAAAGACATTGATCTTTTACAGGAAAAGGGCCAATTATACTTATTTCAAATC

TATAACAAAGATTTTAGCAAGAAGTCCACAGGTAATGATAACCTGCATACGATGTATTTG

AAAAATCTTTTCAGTGAAGAGAATTTGAAGGATATCGTCCTGAAGCTGAACGGTGAGGCT

GAGATCTTCTTCCGCAAATCGTCTATCAAAAACCCCATCATTCACAAAAAGGGAAGTATC

TTAGTAAACCGCACTTATGAAGCGGAGGAAAAGGATCAGTTCGGGAACATCCAGATCGTG

CGCAAGAACATTCCAGAAAACATCTATCAGGAACTTTACAAATATTTCAATGACAAGTCT

GATAAAGAATTATCAGACGAGGCGGCGAAACTTAAAAATGTTGTTGGACACCACGAAGCA

GCGACGAATATTGTAAAGGATTATCGCTACACATACGATAAATACTTTTTGCACATGCCA

ATCACCATTAACTTTAAGGCGAACAAGACAGGTTTCATTAACGACCGTATTCTGCAATAT

ATCGCAAAGGAAAAAGACCTGCACGTTATTGGGATCGATCGTGGCGAACGCAATTTGATC

TACGTAAGCGTTATCGACACTTGCGGAAATATCGTTGAACAAAAAAGCTTTAATATCGTC

AATGGATACGATTACCAAATCAAGCTGAAACAACAAGAAGGGGCACGTCAGATCGCTCGT

AAAGAATGGAAAGAGATTGGTAAGATCAAAGAGATTAAAGAAGGGTATCTTTCTTTAGTA

ATTCACGAGATTTCGAAAATGGTTATTAAATACAATGCGATTATTGCTATGGAAGACTTA

AGCTACGGCTTTAAGAAAGGTCGCTTCAAAGTGGAGCGCCAAGTGTATCAGAAGTTTGAA

ACGATGTTGATTAACAAATTAAATTACCTGGTCTTTAAGGACATCAGTATCACAGAAAAT

GGGGGGTTGCTTAAAGGGTACCAGCTTACATACATCCCTGATAAACTGAAAAATGTCGGT

CATCAGTGCGGATGTATCTTCTATGTACCAGCAGCCTATACCAGTAAGATTGACCCTACT

ACTGGCTTTGTGAATATTTTTAAATTCAAGGATTTAACCGTGGACGCCAAGCGTGAATTT

ATTAAAAAATTTGATTCGATTCGCTACGACAGTGAGAAAAACCTTTTCTGCTTTACCTTT

GACTACAACAATTTTATTACCCAGAACACCGTAATGTCAAAGAGTTCGTGGTCTGTATAT

ACCTACGGTGTTCGCATCAAGCGCCGCTTCGTAAACGGGCGTTTCAGTAACGAATCTGAC

ACCATCGACATCACTAAAGATATGGAGAAGACATTGGAAATGACGGACATTAATTGGCGT

GATGGCCATGACTTACGTCAGGACATTATTGATTACGAAATTGTGCAGCATATCTTCGAG

ATTTTCCGTTTGACAGTTCAGATGCGCAACTCACTGAGTGAGTTAGAAGATCGCGATTAC

GACCGTCTGATCTCACCGGTCCTTAATGAAAACAACATTTTCTACGACTCAGCAAAGGCG

GGTGATGCCCTGCCAAAGGATGCGGACGCTAATGGCGCCTACTGCATCGCCCTGAAAGGA

TTGTATGAAATTAAGCAGATTACAGAAAATTGGAAGGAAGATGGTAAATTTAGCCGTGAT

AAATTAAAAATCTCGAACAAGGATTGGTTCGATTTTATTCAGAACAAACGTTATTTGAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 50
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAACAATGGA

ACAAATAATTTTCAAAATTTTATCGGCATCTCAAGTCTTCAAAAAACCCTTCGCAATGCC

-continued

CTGATTCCAACTGAAACAACCCAGCAATTTATCGTCAAGAACGGCATCATTAAGGAAGAC

GAGTTACGCGGGGAGAACCGTCAAATCCTGAAAGATATCATGGATGACTACTATCGTGGG

TTCATTTCGGAAACCTTGTCTTCAATCGACGACATTGACTGGACGAGTCTTTTCGAGAAA

ATGGAAATTCAGCTTAAAAATGGAGACAACAAGGATACTCTGATTAAGGAACAGACAGAA

TATCGCAAAGCTATCCACAAAAAGTTCGCTAATGATGATCGTTTCAAAAAATATGTTTTCT

GCTAAATTGATTTCCGATATCTTGCCTGAATTTGTAATCCACAACAACAATTATTCTGCT

TCCGAGAAGGAAGAGAAGACCCAGGTCATTAAATTATTCAGCCGCTTTGCAACCAGCTTT

AAAGACTACTTTAAGAATCGCGCTAACTGCTTTTCGGCGGATGACATCTCATCATCATCA

TGCCACCGCATTGTGAACGACAATGCGGAGATCTTCTTTTCGAATGCGTTAGTTTATCGT

CGCATTGTCAAAAGTCTTAGCAATGATGACATCAACAAGATCTCAGGAGACATGAAAGAT

TCCTTAAAGGAGATGTCTCTTGAGGAAATCTATTCGTATGAGAAATACGGCGAGTTCATT

ACCCAGGAAGGTATTAGTTTCTACAATGATATCTGCGGCAAAGTAAATTCTTTTATGAAT

CTGTATTGCCAAAAAAACAAAGAAAACAAGAATCTTTATAAGTTACAAAAGTTACATAAG

CAAATTCTGTGCATCGCTGATACATCTTATGAGGTACCCTACAAATTTGAAAGTGATGAG

GAGGTCTATCAGAGTGTCAACGGCTTCTTAGACAACATCTCTTCCAAACATATCGTGGAA

CGCCTGCGTAAAATCGGAGATAACTACAACGGATATAACTTAGATAAAATCTACATCGTG

TCCAAGTTTTATGAAAGTGTGAGCCAAAAAACATATCGTGACTGGGAAACCATTAACACC

GCATTGGAAATTCACTATAACAACATTTTGCCAGGCAACGGGAAAAGTAAGGCGGACAAA

GTTAAGAAAGCAGTTAAAAATGACCTGCAAAAAAGCATCACTGAAATTAACGAATTGGTA

TCGAATTACAAATTATGTAGCGACGATAATATCAAAGCAGAAACTTACATTCACGAGATT

AGTCACATTTTAAATAACTTCGAGGCCCAGGAATTGAAATACAATCCCGAAATTCATTTG

GTTGAATCAGAACTGAAAGCATCAGAGTTGAAAAATGTGTTAGATGTCATTATGAATGCG

TTTCATTGGTGCTCTGTGTTCATGACCGAGGAACTGGTTGATAAAGATAACAACTTTTAC

GCTGAATTGGAGGAGATTTACGATGAGATTTACCCGGTCATTTCGCTTTATAACTTAGTG

CGCAATTATGTGACGCAGAAACCATATTCCACGAAGAAAATCAAACTTAATTTTGGCATC

CCTACTCTGGCTGATGGTTGGTCGAAATCGAAAGAGTACAGCAACAACGCGATCATTCTT

ATGCGTGACAATCTTTACTATTTGGGCATTTTTAATGCCAAGAATAAGCCAGATAAGAAA

ATCATTGAGGGGAATACTTCCGAGAATAAGGGGGATTACAAAAAGATGATCTATAACTTG

CTGCCCGGCCCCAACAAAATGATTCCTAAGGTTTTCTTGTCAAGCAAGACGGGCGTCGAA

ACATATAAGCCGTCAGCTTATATTCTGGAAGGCTATAAACAGAATAAGCACATCAAGTCT

TCCAAGGACTTTGACATCACTTTTTGCCACGATTTGATCGACTACTTTAAGAACTGTATT

GCGATTCATCCGGAATGGAAGAACTTCGGTTTCGACTTTTCCGATACCTCAACATACGAG

GATATCAGCGGCTTCTACCGTGAAGTCGAGCTTCAAGGCTACAAGATCGATTGGACATAT

ATTTCAGAGAAGGACATTGATTTGTTACAAGAGAAAGGTCAACTTTACTTATTTCAGATC

TATAACAAAGACTTTTCGAAGAAATCGACAGGAAACGATAACTTACACACTATGTATTTA

AAAAATCTGTTTTCGGAGGAAAACCTGAAAGATATTGTGCTGAAACTTAACGGCGAGGCA

GAGATCTTTTTCCGTAAAAGCTCAATCAAGAATCCTATCATCCATAAAAAAGGTAGTATT

CTTGTCAACCGCACATATGAAGCGGAGGAGAAGGACCAATTCGGAAACATCCAAATTGTC

CGTAAGAATATTCCGGAGAACATTTACCAAGAGTTGTATAAATACTTTAACGATAAGTCA

GATAAGGAACTTAGCGATGAGGCGGCGAAGCTTAAAAACGTAGTTGGGCATCATGAAGCT

-continued

GCTACCAACATTGTAAAAGATTACCGTTACACCTATGACAAGTATTTCTTGCACATGCCC

ATTACGATCAATTTCAAAGCAAATAAGACAGGCTTTATCAATGATCGCATCCTGCAGTAC

ATTGCTAAAGAGAAGGATTTGCATGTTATCGGTATTGATCGCGGAGAGCGCAATTTGATC

TACGTCTCCGTAATCGACACTTGCGGTAACATTGTTGAGCAGAAGTCGTTCAACATCGTT

AATGGTTATGATTACCAAATCAAGCTGAAGCAGCAAGAGGGTGCCCGCCAGATCGCGCGT

AAGGAATGGAAAGAAATCGGGAAAATTAAAGAGATCAAAGAAGGCTATTTGTCTCTGGTA

ATTCACGAAATCAGCAAGATGGTGATCAAGTATAACGCGATCATTGCGATGGAGGATCTT

TCTTATGGCTTCAAGAAAGGGCGCTTTAAAGTCGAACGCCAGGTCTACCAGAAATTTGAG

ACAATGCTTATCAACAAGCTTAACTATCTTGTATTTAAGGATATTTCCATCACTGAGAAC

GGAGGACTTTTAAAGGGGTACCAACTGACGTACATTCCTGATAAGCTGAAGAACGTTGGT

CATCAATGCGGATGCATCTTCTATGTGCCAGCGGCTTACACCTCCAAAATCGATCCCACT

ACAGGCTTTGTCAATATCTTCAAATTCAAGGATTTGACCGTTGACGCGAAGCGCGAGTTT

ATCAAGAAGTTTGATAGCATTCGCTACGACAGCGAAAAAAATTTATTTTGTTTTACTTTC

GACTACAATAACTTTATTACTCAGAACACTGTCATGTCAAAGAGTTCGTGGAGTGTCTAC

ACGTACGGAGTACGTATTAAGCGCCGTTTCGTCAACGGACGCTTCTCAAACGAAAGCGAC

ACGATCGACATCACCAAAGACATGGAAAAAACTCTTGAGATGACGGATATCAATTGGCGC

GACGGCCATGACCTGCGTCAGGATATCATTGATTACGAGATCGTTCAGCACATCTTCGAA

ATCTTCCGCCTTACCGTCCAGATGCGCAACAGTTTAAGCGAGCTTGAAGACCGCGACTAC

GATCGTTTGATTAGCCCCGTTCTGAACGAGAATAATATTTTCTACGACAGCGCAAAGGCC

GGTGATGCTTTGCCAAAGGACGCAGACGCGAATGGAGCCTACTGCATCGCCCTGAAGGGC

TTATATGAGATTAAGCAAATTACCGAAAATTGGAAGGAAGATGGTAAGTTCTCCCGTGAT

AAGCTTAAAATTAGCAATAAGGATTGGTTCGACTTCATCCAGAACAAACGTTACCTGAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 51

ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAACAACGGA

ACAAACAATTTCCAAAACTTCATCGGTATCTCTTCGTTGCAGAAGACTCTGCGTAATGCT

TTGATCCCGACGGAGACAACCCAACAATTTATCGTCAAAAACGGTATTATTAAGGAGGAC

GAGTTACGTGGAGAAAATCGTCAAATCCTTAAGGACATCATGGACGATTATTATCGCGGG

TTTATTTCTGAAACCCTGAGCAGTATCGATGATATCGACTGGACCTCACTTTTTGAGAAA

ATGGAGATCCAGTTGAAGAACGGTGATAACAAAGACACTCTGATCAAAGAGCAAACTGAA

TACCGCAAGGCAATTCACAAAAAGTTCGCCAACGACGACCGTTTCAAGAATATGTTCTCA

GCTAAGTTAATCAGCGACATTTTGCCAGAGTTCGTTATCCACAACAATAATTATAGTGCT

TCAGAGAAGGAGGAAAAAACCCAAGTGATTAAACTTTTTTCGCGCTTTGCAACCTCATTC

AAGGACTACTTCAAGAATCGCGCGAATTGCTTCAGTGCGGACGACATTTCTTCTTCAAGT

TGCCATCGTATCGTTAACGATAACGCGGAAATTTTCTTCTCTAATGCTTTGGTGTATCGC

CGCATTGTAAAAATCGCTTAGTAACGATGACATTAATAAGATCTCAGGTGATATGAAAGAT

TCATTGAAGGAAATGAGCTTGGAAGAGATTTACAGTTACGAAAAATATGGAGAATTTATT

ACTCAGGAAGGCATCTCATTCTATAACGATATCTGCGGGAAGGTAAATTCGTTTATGAAC

-continued

TTATATTGCCAGAAAAAATAAAGAGAATAAAAATTTGTATAAGCTTCAGAAGTTGCACAAA

CAGATCCTGTGCATTGCAGACACCTCGTATGAGGTTCCGTATAAATTTGAGTCCGATGAA

GAAGTGTATCAGTCTGTGAATGGTTTCTTAGATAATATCTCTTCCAAGCATATTGTCGAA

CGCCTGCGCAAAATTGGTGATAACTATAACGGATACAATCTGGATAAAATTTACATCGTT

TCTAAATTTTACGAGTCAGTCTCGCAGAAGACCTACCGCGACTGGGAAACAATTAACACG

GCATTGGAGATTCACTACAATAATATCTTGCCTGGTAACGGTAAGTCTAAGGCAGATAAG

GTAAAAAAAGCTGTGAAAAACGACCTTCAGAAAAGCATCACGGAGATTAATGAGCTGGTG

AGTAATTACAAATTATGTTCAGACGATAATATTAAAGCTGAAACGTATATCCATGAAATC

TCGCATATCTTGAACAACTTCGAGGCCCAAGAACTTAAATATAACCCCGAAATCCATTTA

GTCGAGTCTGAATTGAAAGCGTCGGAATTAAAAAACGTCTTAGACGTCATTATGAACGCG

TTTCACTGGTGTTCAGTTTTCATGACCGAAGAGCTGGTCGACAAAGACAACAACTTCTAT

GCGGAATTGGAGGAAATCTATGATGAAATCTACCCTGTTATTTCACTGTATAACCTTGTG

CGCAACTATGTCACTCAGAAGCCGTATTCGACCAAAAAAATTAAATTGAATTTCGGTATC

CCTACTCTTGCAGACGGATGGAGTAAAAGCAAGGAATACAGTAATAACGCCATTATTCTT

ATGCGCGACAATTTATACTACCTGGGCATCTTTAACGCAAAGAATAAGCCGGATAAGAAG

ATTATTGAGGGTAACACCAGTGAGAACAAGGGCGACTATAAGAAGATGATCTATAACTTA

TTGCCAGGTCCAAATAAAATGATCCCAAAAGTATTCTTATCATCAAAGACGGGAGTTGAA

ACCTATAAGCCTAGTGCCTATATTCTTGAGGGATATAAACAGAACAAGCACATTAAGTCG

TCTAAGGATTTTGACATTACGTTCTGCCATGACTTAATCGACTATTTTAAAAACTGTATT

GCGATTCACCCCGAATGGAAGAATTTTGGATTCGATTTTTCGGATACCTCGACCTATGAA

GATATTTCGGGATTTTATCGTGAAGTGGAGTTGCAAGGCTATAAAATCGATTGGACCTAT

ATCTCAGAAAAAGACATTGATTTATTACAGGAAAAGGGACAACTGTACCTTTTCCAAATT

TATAACAAGGACTTTTCTAAAAAGTCCACAGGAAATGATAACCTTCACACCATGTACCTG

AAGAACCTTTTCTCAGAGGAAAACCTGAAGGACATTGTCCTTAAGTTAAATGGAGAAGCG

GAGATCTTTTTCCGTAAATCTAGTATCAAGAATCCGATTATCCATAAAAAAGGTTCGATT

TTGGTAAATCGCACCTATGAAGCGGAAGAGAAAGATCAATTTGGTAACATCCAGATCGTG

CGCAAGAATATCCCGGAGAACATTTACCAAGAGCTGTATAAGTACTTCAATGATAAGTCT

GATAAGGAACTGTCAGATGAAGCTGCGAAATTGAAGAACGTGGTTGGGCATCATGAAGCC

GCTACCAATATCGTCAAGGATTACCGTTATACCTATGACAAATATTTCTTACACATGCCG

ATTACGATCAATTTTAAGGCAAACAAGACAGGATTCATCAACGACCGTATCTTGCAGTAT

ATTGCCAAAGAGAAGGATCTGCATGTGATCGGTATTGACCGCGGGGAGCGCAATTTAATC

TATGTATCGGTGATCGATACTTGTGGTAACATCGTAGAACAAAAGAGCTTTAACATCGTG

AATGGTTACGACTATCAGATCAAGCTGAAACAACAGGAAGGAGCCCGCCAGATCGCTCGC

AAGGAATGGAAAGAAATCGGGAAAATTAAGGAAATCAAGGAAGGCTACCTTTCATTGGTC

ATTCACGAAATTTCGAAAATGGTAATTAAGTACAACGCGATCATCGCCATGGAGGACCTT

TCGTACGGATTTAAGAAGGGTCGTTTCAAAGTTGAGCGCCAGGTATACCAAAAATTCGAG

ACTATGCTTATCAACAAACTTAACTACTTGGTCTTTAAGGACATTTCTATTACCGAAAAC

GGCGGCTTACTTAAAGGCTATCAATTGACATATATTCCCGACAAACTGAAGAATGTTGGA

CATCAATGCGGGTGTATTTTCTATGTGCCGGCAGCTTACACTAGTAAGATCGACCCTACA

ACCGGGTTCGTAAACATTTTTAAATTCAAAGACTTAACAGTCGATGCGAAGCGTGAATTT

ATTAAGAAGTTTGATAGTATCCGCTATGACAGTGAAAAGAACTTGTTTTGCTTTACGTTC

GACTACAATAACTTTATTACACAGAACACGGTCATGTCTAAATCATCATGGTCGGTTTAC

ACATATGGGGTGCGCATCAAGCGTCGCTTTGTAAATGGCCGTTTTAGTAATGAGAGCGAC

ACAATCGACATCACAAAGGATATGGAGAAAACTCTTGAGATGACAGACATCAATTGGCGT

GACGGTCATGACTTACGCCAAGATATCATCGACTACGAAATCGTACAGCATATTTTTGAG

ATTTTTCGTCTTACTGTGCAAATGCGTAATTCTTTATCCGAACTGGAAGATCGTGATTAC

GACCGCTTGATTAGTCCCGTCTTAAATGAGAACAATATTTTCTATGATTCTGCGAAAGCC

GGAGATGCACTGCCCAAAGACGCTGATGCCAATGGCGCGTATTGCATTGCATTAAAAGGA

TTATATGAGATTAAACAGATTACCGAAAATTGGAAAGAGGACGGTAAATTCTCACGCGAT

AAATTGAAGATTTCTAACAAGGACTGGTTCGACTTTATCCAAAATAAACGTTATCTTAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 52
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAATAACGGT

ACCAACAACTTTCAGAATTTCATTGGCATTAGCTCGCTTCAAAAAACTTTACGCAATGCT

CTTATTCCGACTGAGACGACACAACAGTTTATCGTTAAGAATGGCATCATCAAAGAAGAT

GAATTACGCGGAGAAAACCGCCAGATCCTGAAAGACATTATGGACGATTATTACCGTGGG

TTCATCTCCGAGACGTTGTCATCGATCGATGACATCGACTGGACGTCACTTTTTGAAAAA

ATGGAGATCCAGTTAAAGAACGGTGACAATAAGGATACATTGATCAAAGAACAGACCGAG

TACCGTAAAGCGATTCATAAAAAGTTTGCGAACGATGATCGCTTCAAGAATATGTTTTCT

GCGAAATTAATTTCCGACATTTTACCTGAATTTGTTATTCATAATAACAACTACTCGGCG

TCTGAGAAAGAGGAGAAAACCCAAGTGATTAAACTTTTTTCACGTTTCGCAACGTCGTTC

AAAGACTATTTTAAAAATCGTGCTAATTGCTTTAGCGCGGATGACATCAGCTCTAGTTCA

TGTCATCGCATTGTCAACGATAATGCTGAGATCTTTTTCAGTAATGCGTTAGTGTACCGT

CGTATTGTGAAGTCCTTATCTAATGATGATATCAATAAGATCAGCGGGGATATGAAGGAC

TCACTTAAGGAGATGAGCTTGGAGGAAATCTATTCCTATGAGAAGTATGGTGAGTTTATT

ACGCAAGAAGGAATTAGCTTTTACAACGATATCTGTGGAAAGGTGAATTCGTTTATGAAT

TTGTATTGCCAGAAAAATAAGGAGAACAAGAACCTTTATAAATTGCAAAAGTTACACAAG

CAAATCCTGTGCATTGCAGATACTTCCTACGAGGTGCCTTACAAGTTTGAATCCGACGAA

GAGGTCTACCAATCTGTAAACGGTTTCTTAGATAATATTAGTTCCAAGCATATTGTGGAG

CGCCTTCGTAAAATTGGCGATAATTACAACGGTTACAATTTAGACAAAATTTACATTGTC

AGTAAATTCTACGAGTCCGTATCTCAAAAGACGTATCGTGATTGGGAGACTATCAATACG

GCCCTGGAGATCCACTACAACAATATCTTGCCCGGTAATGGTAAGTCGAAGGCCGATAAA

GTTAAGAAAGCGGTGAAAAATGACTTACAGAAGTCAATCACCGAAATTAACGAATTGGTG

TCCAATTATAAATTGTGTTCAGATGATAATATCAAAGCCGAGACCTACATTCATGAGATT

TCCCATATCTTAAATAATTTCGAGGCGCAAGAGCTTAAGTATAACCCAGAAATCCACCTG

GTAGAATCTGAGTTGAAGGCGTCAGAGTTAAAAAATGTTTTAGATGTCATTATGAACGCG

TTTCACTGGTGCTCCGTATTTATGACGGAGGAATTAGTAGATAAAGACAACAATTTCTAT

GCCGAACTTGAGGAAATCTATGATGAGATCTATCCCGTCATTAGCCTGTATAACTTGGTC

CGCAACTATGTTACCCAAAAACCGTACAGTACCAAGAAGATTAAGCTGAATTTCGGCATT

-continued

CCTACACTGGCTGATGGTTGGAGTAAATCGAAGGAATATTCGAATAACGCGATTATCTTG

ATGCGCGACAACTTATACTATTTGGGGATCTTTAACGCCAAAAACAAACCGGATAAGAAG

ATTATTGAGGGAAACACATCAGAGAACAAAGGCGACTACAAAAAAATGATTTACAACTTG

TTACCGGGGCCTAACAAAATGATCCCGAAGGTGTTCTTATCCAGTAAAACAGGCGTTGAG

ACCTACAAACCTTCCGCATACATCCTGGAAGGGTATAAGCAGAACAAGCACATTAAGTCC

AGCAAGGATTTCGATATTACCTTCTGTCATGATTTAATTGACTATTTCAAGAACTGTATT

GCAATCCACCCCGAGTGGAAGAACTTCGGATTCGACTTCTCAGATACGAGCACATATGAG

GACATCTCGGGGTTCTATCGTGAAGTAGAACTGCAGGGATATAAAATTGATTGGACATAT

ATTTCCGAAAAAGACATCGACCTTTTACAAGAGAAGGGTCAACTTTACTTGTTCCAAATT

TACAATAAAGACTTCTCAAAAAAAAGCACGGGTAACGATAATTTACACACTATGTATTTA

AAGAACCTTTTCTCGGAAGAGAATTTAAAGGATATCGTATTGAAGTTGAATGGAGAAGCG

GAGATCTTCTTCCGTAAGTCCAGTATTAAAAACCCTATTATTCACAAGAAGGGATCGATT

TTAGTTAACCGCACATACGAGGCCGAAGAGAAGGACCAATTTGGGAACATTCAAATTGTC

CGCAAAAACATCCCTGAGAACATTTATCAAGAGCTTTATAAGTACTTTAACGATAAGTCC

GATAAGGAATTGTCAGATGAGGCGGCAAAGTTGAAGAATGTCGTGGGGCATCATGAAGCT

GCCACCAACATTGTGAAGGACTACCGCTACACTTACGACAAATACTTCCTGCACATGCCC

ATTACGATCAATTTTAAGGCCAATAAGACAGGCTTTATTAACGACCGTATTCTTCAATAT

ATCGCTAAGGAGAAGGACCTTCATGTGATTGGGATCGACCGCGGAGAACGTAATTTAATT

TATGTGTCCGTCATCGATACGTGTGGAAATATCGTGGAACAGAAATCATTCAATATCGTG

AATGGCTATGATTACCAGATCAAATTAAAACAGCAGGAGGGCGCTCGCCAAATTGCGCGT

AAGGAATGGAAAGAGATCGGAAAAATCAAAGAAATCAAAGAAGGATATTTGTCATTGGTG

ATCCATGAGATTTCAAAAATGGTAATTAAATATAATGCAATTATCGCAATGGAAGACCTG

TCCTATGGTTTTAAGAAGGGTCGTTTCAAGGTAGAACGCCAAGTGTATCAAAAGTTCGAG

ACGATGCTGATCAATAAGCTGAATTATCTTGTGTTTAAGGACATTAGCATCACGGAAAAT

GGAGGGCTGTTGAAAGGCTATCAACTGACGTATATCCCTGACAAGCTGAAAAATGTTGGC

CATCAGTGCGGGTGCATTTTCTACGTCCCCGCGGCGTATACAAGCAAGATCGATCCTACT

ACGGGATTCGTAAATATTTTTAAATTCAAAGACTTAACCGTGGACGCCAAGCGCGAATTC

ATTAAGAAGTTTGATAGCATTCGCTACGATTCAGAAAAAAATCTTTTCTGTTTTACGTTC

GATTACAACAATTTTATCACCCAGAACACAGTGATGAGCAAGTCATCCTGGTCTGTCTAT

ACCTACGGTGTCCGTATCAAACGCCGCTTCGTCAACGGACGCTTCTCTAATGAATCTGAT

ACCATTGACATCACCAAGGACATGGAAAAGACACTTGAGATGACAGATATTAACTGGCGT

GACGGACATGACCTGCGTCAGGACATCATCGATTATGAGATTGTTCAGCATATCTTCGAG

ATCTTCCGCCTGACAGTACAAATGCGCAATTCACTGTCAGAACTTGAAGACCGCGACTAT

GACCGCCTGATCTCTCCAGTATTAAATGAGAACAATATCTTTTATGACAGTGCTAAGGCC

GGCGATGCCCTTCCGAAAGATGCTGATGCTAACGGAGCTTATTGTATTGCATTAAAGGGT

CTTTATGAGATCAAGCAAATTACCGAGAATTGGAAGGAGGATGGCAAATTCTCGCGCGAC

AAACTGAAAATCAGTAACAAGGACTGGTTCGATTTTATTCAGAATAAACGTTACCTGAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 53
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAATAACGGA

ACGAACAACTTCCAGAACTTCATCGGCATCAGTTCTTTACAAAAAACCCTGCGTAACGCC

CTTATTCCGACTGAGACAACACAACAGTTCATCGTTAAAAACGGAATTATCAAAGAGGAC

GAGTTGCGCGGCGAGAATCGCCAAATTTTGAAAGATATTATGGACGACTATTATCGTGGT

TTTATTTCAGAAACACTGAGTTCGATTGACGATATCGATTGGACGAGCCTGTTTGAGAAA

ATGGAAATCCAGTTGAAAAATGGCGATAATAAAGACACTTTAATCAAAGAACAAACCGAG

TATCGTAAAGCGATCCATAAAAAGTTCGCTAATGACGATCGTTTTAAGAATATGTTCAGT

GCGAAACTGATTTCAGACATTTTGCCCGAGTTCGTGATCCATAATAACAACTATTCCGCC

TCGGAAAAGGAAGAAAAAACCCAGGTGATTAAGCTGTTCAGTCGCTTCGCAACATCTTTC

AAGGATTATTTCAAGAATCGCGCGAATTGCTTCAGTGCGGACGATATTTCTAGTTCAAGC

TGCCATCGTATCGTTAATGATAACGCGGAGATTTTTTTTAGCAATGCTCTGGTGTACCGC

CGCATTGTTAAGTCACTGTCCAACGATGATATTAACAAGATCTCAGGAGACATGAAAGAC

TCGCTTAAAGAGATGAGTCTGGAAGAGATCTATTCTTATGAGAAGTATGGCGAGTTTATT

ACCCAAGAAGGAATCTCATTCTACAATGATATTTGTGGAAAGGTGAACAGCTTTATGAAT

CTTTACTGCCAAAAAAACAAGGAGAATAAGAATCTTTACAAACTTCAGAAGTTACATAAA

CAGATTTTGTGTATTGCGGATACGTCTTATGAAGTCCCCTACAAATTTGAATCGGATGAA

GAGGTATACCAAAGTGTGAACGGATTCTTGGACAATATTTCTTCTAAACATATTGTTGAA

CGCTTACGTAAGATCGGGGATAACTACAATGGCTACAATCTTGACAAAATCTACATTGTT

AGCAAATTCTACGAGAGTGTCAGCCAAAAGACGTACCGCGATTGGGAAACAATTAATACT

GCGCTTGAGATTCACTATAATAACATTTTACCAGGCAACGGCAAGTCCAAGGCGGATAAA

GTTAAAAAAGCTGTTAAAAACGATTTGCAAAAATCTATCACAGAAATTAACGAGTTAGTT

AGTAACTACAAACTGTGCTCCGATGACAACATTAAGGCTGAGACGTATATCCATGAGATC

TCTCACATCTTAAACAATTTTGAAGCTCAAGAACTTAAGTACAATCCGGAAATCCACCTG

GTGGAATCCGAGCTGAAGGCTAGCGAACTGAAGAACGTATTGGACGTGATCATGAACGCG

TTCCACTGGTGTTCTGTCTTTATGACGGAAGAGCTTGTCGACAAAGATAATAACTTTTAC

GCGGAACTTGAGGAAATTTACGATGAGATTTACCCAGTTATTTCATTGTATAACCTTGTC

CGTAATTACGTGACCCAAAAGCCTTATAGTACGAAAAAAATCAAATTAAATTTTGGAATC

CCAACACTGGCTGACGGTTGGAGCAAATCTAAGGAGTATTCTAATAACGCAATCATCTTA

ATGCGTGACAACCTGTATTATTTGGGTATCTTCAATGCCAAAAATAAGCCTGACAAAAAG

ATTATCGAAGGAAATACTTCGGAGAATAAGGGGGATTACAAAAAAATGATTTACAATTTG

CTGCCCGGGCCGAACAAGATGATCCCCAAAGTGTTCTTATCCTCGAAGACTGGTGTAGAA

ACATACAAGCCAAGCGCATACATTCTGGAGGGTTACAAGCAAAACAAACACATCAAATCT

TCAAAAGACTTTGACATTACATTTTGCCATGATCTTATTGACTACTTCAAAAACTGCATT

GCTATTCACCCCGAGTGGAAGAACTTTGGGTTTGACTTCAGCGACACGTCTACGTATGAG

GACATCTCCGGGTTCTACCGTGAAGTTGAGTTACAAGGGTATAAGATTGACTGGACGTAT

ATTTCAGAGAAAGATATCGATCTTTTGCAGGAAAAGGGCCAGTTATATTTATTCCAGATT

TACAACAAGGACTTTAGTAAGAAGTCAACAGGAAATGACAACTTGCATACGATGTATTTG

AAAAATCTTTTTTCTGAGGAAAATCTTAAGGACATCGTACTGAAATTGAATGGCGAGGCT

GAAATCTTCTTCCGTAAATCCTCCATTAAGAATCCCATTATCCACAAAAAGGGGTCTATC

-continued

CTGGTGAATCGTACCTACGAGGCAGAGGAGAAGGATCAATTCGGAAATATTCAGATTGTT

CGTAAGAACATCCCCGAGAACATTTATCAAGAATTGTATAAGTACTTTAATGACAAATCT

GACAAAGAGTTATCCGACGAAGCTGCGAAACTGAAAAACGTTGTTGGTCACCACGAGGCC

GCCACTAATATCGTAAAAGACTACCGTTATACCTATGACAAGTACTTTTTGCACATGCCG

ATCACTATCAACTTCAAGGCGAATAAGACGGGCTTCATTAACGATCGTATCCTGCAATAC

ATCGCCAAGGAGAAGGACCTTCACGTCATTGGGATTGACCGTGGTGAGCGTAACCTGATT

TATGTAAGCGTCATTGATACCTGCGGTAATATCGTCGAACAGAAAAGTTTCAACATTGTA

AATGGATATGACTATCAGATCAAACTTAAGCAGCAGGAGGGTGCACGCCAGATTGCCCGC

AAGGAATGGAAGGAGATTGGGAAGATTAAGGAAATTAAAGAAGGTTACTTATCACTGGTT

ATTCACGAGATCAGTAAAATGGTAATCAAATATAACGCGATCATTGCCATGGAGGATCTG

AGCTATGGCTTTAAAAAGGGCCGTTTCAAAGTCGAGCGCCAGGTATATCAAAAGTTTGAA

ACAATGCTGATTAACAAATTAAACTATCTGGTTTTCAAAGATATTTCGATCACTGAAAAT

GGCGGGCTGTTGAAGGGATACCAACTTACATACATCCCTGACAAACTGAAAAATGTCGGT

CACCAATGTGGATGTATCTTTTATGTACCAGCAGCGTATACGAGCAAAATCGATCCAACT

ACGGGTTTTGTGAACATCTTTAAGTTCAAGGATTTGACAGTAGATGCCAAACGCGAGTTC

ATTAAAAAATTTGATTCAATTCGCTACGATTCAGAGAAAAATCTTTTTTGTTTCACGTTC

GATTACAATAATTTCATTACGCAGAACACAGTAATGTCAAAGTCAAGCTGGTCGGTCTAC

ACGTATGGAGTCCGTATTAAACGTCGTTTTGTAAACGGCCGTTTCTCAAATGAATCAGAT

ACAATTGATATTACGAAGGATATGGAGAAGACATTAGAGATGACTGACATTAACTGGCGC

GACGGACATGATCTTCGTCAGGACATTATTGATTATGAGATTGTACAGCATATCTTTGAG

ATCTTCCGCCTGACCGTTCAGATGCGCAATTCGTTGTCCGAGTTAGAAGACCGCGATTAC

GACCGTTTAATCAGTCCCGTCTTAAACGAAAATAACATCTTCTACGATTCAGCCAAGGCA

GGCGATGCCTTGCCAAAGGATGCTGACGCAAATGGCGCATACTGTATTGCGTTGAAAGGC

CTTTATGAAATCAAGCAAATTACCGAAAACTGGAAAGAAGACGGAAAATTCTCCCGTGAT

AAGTTGAAAATCTCTAATAAGGATTGGTTCGATTTCATCCAAAATAAACGCTATTTGAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 54

ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAACAACGGA

ACTAATAATTTCCAAAATTTTATAGGCATCTCTTCTTTACAGAAGACTCTTCGTAACGCC

CTAATCCCGACTGAGACCACACAACAATTCATAGTGAAAAATGGGATCATTAAAGAAGAC

GAGCTGCGTGGGGAGAACAGGCAGATCCTAAAAGACATAATGGACGATTATTATAGAGGG

TTCATCTCAGAGACATTATCTAGCATCGACGACATTGACTGGACCTCCCTGTTTGAAAAA

ATGGAAATCCAGCTGAAGAATGGTGACAATAAAGACACATTAATAAAAGAACAAACAGAG

TACAGGAAAGCCATCCACAAGAAGTTCGCAAACGATGACAGATTCAAAAATATGTTCAGT

GCGAAGCTAATATCCGACATCTTACCAGAGTTTGTAATACACAATAACAATTACAGCGCG

AGCGAAAAGGAAGAGAAAACGCAAGTAATTAAGCTTTTTAGTAGGTTCGCTACCTCTTTC

AAAGATTACTTCAAAAATCGTGCTAACTGCTTCTCAGCCGACGACATATCTTCAAGTTCC

TGTCACCGTATCGTGAATGATAACGCTGAGATATTCTTCTCAAACGCCCTTGTATACCGT

-continued

AGGATCGTAAAGTCCTTATCTAACGATGATATAAACAAGATCAGTGGAGACATGAAAGAC

AGCCTTAAAGAGATGTCTCTAGAAGAAATTTACTCCTATGAAAAGTATGGGGAGTTTATA

ACACAGGAGGGGATCAGCTTCTACAACGACATCTGCGGAAAGGTGAACAGTTTCATGAAT

CTTTACTGCCAGAAGAATAAAGAGAACAAAAATCTTTATAAGCTTCAAAAGTTGCACAAA

CAAATACTGTGCATTGCCGATACATCATATGAGGTCCCCTATAAGTTCGAATCTGATGAG

GAAGTTTATCAATCTGTTAACGGCTTTCTAGACAATATCAGCTCAAAACACATCGTAGAA

AGACTGAGGAAAATAGGTGATAATTATAATGGATACAACTTGGATAAAATATATATAGTC

TCTAAATTTTACGAGTCAGTATCCCAGAAAACGTATAGGGATTGGGAGACCATCAACACG

GCGTTAGAGATTCATTACAATAACATCTTACCGGGAAACGGAAAAAGTAAGGCGGACAAA

GTAAAGAAAGCCGTTAAAAATGACTTACAAAAGAGTATAACAGAAATAAACGAACTAGTA

AGCAACTACAAGCTTTGTTCCGATGATAATATCAAGGCCGAGACATATATCCATGAGATC

TCCCACATTCTAAACAATTTCGAAGCGCAAGAACTTAAATATAATCCCGAAATCCACCTG

GTGGAAAGTGAACTAAAGGCTAGTGAGTTAAAGAACGTTCTTGATGTTATCATGAACGCC

TTCCATTGGTGCTCTGTTTTTATGACCGAGGAGTTGGTTGATAAAGATAATAATTTCTAC

GCTGAATTAGAGGAGATATACGACGAAATCTACCCAGTGATTTCACTATACAACTTGGTC

AGGAACTATGTTACACAAAAGCCGTACAGCACTAAGAAAATTAAGCTAAATTTCGGTATC

CCCACGTTAGCCGACGGGTGGAGCAAGTCCAAAGAATATTCCAACAATGCGATTATTTTA

ATGCGTGACAATCTTTATTACCTTGGCATCTTCAATGCCAAAAACAAACCTGACAAAAAG

ATTATAGAAGGTAATACGTCCGAGAACAAAGGCGATTACAAGAAGATGATTTATAACCTA

CTGCCCGGACCAAACAAAATGATCCCCAAAGTTTTTCTTAGTTCTAAAACCGGCGTAGAG

ACGTATAAACCTTCTGCCTATATCTTAGAGGGATATAAGCAGAACAAACATATCAAATCT

TCCAAGGACTTTGATATTACATTCTGCCACGATTTAATTGACTACTTCAAAAATTGCATA

GCGATACATCCGGAGTGGAAGAACTTTGGCTTCGACTTCAGTGATACATCCACCTATGAG

GATATATCAGGCTTCTATCGTGAGGTCGAATTGCAAGGGTACAAAATCGATTGGACGTAT

ATATCCGAGAAAGACATAGACCTTCTTCAAGAAAAGGGGCAGTTATATTTATTCCAAATA

TACAACAAGGACTTCAGTAAGAAGTCAACAGGTAATGACAACTTACACACCATGTACTTG

AAAAATTTATTTTCTGAAGAAAACCTAAAGGACATTGTACTAAAACTGAACGGGGAGGCA

GAAATTTTTTTTAGAAAGAGCAGCATAAAAAACCCAATAATTCATAAGAAAGGAAGCATT

TTAGTTAATAGGACGTACGAGGCAGAGGAAAAGGACCAGTTTGGCAATATCCAGATCGTA

AGGAAAAATATTCCTGAAAACATATATCAGGAACTATATAAATACTTTAACGACAAATCC

GACAAAGAATTATCCGACGAGGCTGCAAAGCTGAAGAACGTCGTAGGGCACCATGAGGCA

GCGACTAATATTGTGAAAGACTATAGGTATACATACGACAAATACTTTCTGCACATGCCC

ATCACGATTAACTTCAAGGCGAACAAGACGGGATTCATTAACGACCGTATATTACAATAT

ATTGCTAAGGAGAAAGATCTGCATGTAATAGGTATCGACAGAGGCGAACGTAATTTAATC

TACGTGTCCGTCATCGACACGTGCGGGAACATCGTAGAGCAAAAGAGTTTTAATATAGTA

AATGGCTATGATTACCAAATTAAGCTAAAGCAGCAAGAAGGAGCAAGACAGATAGCTAGG

AAAGAATGGAAGGAGATAGGAAAAATAAAGGAGATCAAGGAGGGGTATCTTAGCCTAGTA

ATTCATGAAATATCTAAGATGGTTATCAAATACAACGCTATCATAGCGATGGAAGACTTA

TCTTATGGTTTCAAGAAAGGAAGGTTCAAAGTAGAGCGTCAAGTTTATCAAAAGTTCGAA

ACGATGTTGATTAATAAACTAAACTATTTGGTATTTAAAGATATATCTATCACCGAGAAT

GGTGGTCTACTAAAGGGTTACCAGCTTACATACATACCGGACAAACTTAAAAACGTCGGA

-continued

CATCAGTGTGGATGCATTTTCTACGTTCCAGCTGCATATACCAGCAAGATCGACCCAACG

ACTGGGTTCGTAAATATTTTTAAATTCAAGGATTTGACTGTCGACGCCAAAAGAGAGTTC

ATAAAAAAGTTCGATTCAATTAGGTACGACAGCGAAAAGAATTTGTTCTGCTTTACTTTT

GACTATAACAATTTCATTACTCAGAACACTGTAATGTCTAAGTCCTCTTGGTCAGTCTAT

ACTTATGGCGTTCGTATCAAACGTAGATTTGTTAACGGTAGATTCTCAAATGAAAGTGAT

ACAATAGATATCACGAAAGATATGGAGAAAACATTAGAAATGACAGACATAAACTGGAGA

GACGGACATGACTTGAGACAGGACATTATTGACTACGAGATCGTGCAGCACATCTTTGAG

ATCTTTCGTTTGACCGTACAAATGCGTAACAGTTTATCTGAGCTTGAGGACAGGGACTAC

GATAGATTGATATCACCTGTATTAAATGAGAATAACATCTTCTATGATTCCGCAAAAGCA

GGCGACGCTCTACCCAAAGACGCTGATGCGAACGGTGCTTATTGCATAGCTTTAAAGGGT

TTGTATGAGATCAAACAGATAACAGAAAATTGGAAGGAAGATGGTAAGTTCTCCCGTGAC

AAGCTTAAAATATCAAATAAGGACTGGTTCGATTTTATACAGAATAAGCGTTATTAAAAC

GTCCGGCAGCGACCAAAAAAGCCGGCCAGGCGAAGAAAAAAAAAGCGTCAGGTAGCGGCG

CAGGCAGCCCGAAAAAGAAACGTAAAGTCGAGGATCCGAAAAAGAAACGTAAGGTTATTC

CGGGCTAA

SEQ ID NO: 55
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAACAATGGA

ACTAATAACTTCCAGAATTTCATTGGTATCTCCTCTTTACAAAAAACTCTAAGAAACGCC

CTAATTCCGACTGAAACTACACAGCAATTCATCGTCAAAAACGGGATCATTAAGGAGGAT

GAGTTGAGGGGTGAAAATCGTCAAATTCTTAAAGACATCATGGACGACTACTACAGGGGG

TTCATCAGCGAGACGTTATCTAGTATAGACGATATAGACTGGACTTCACTGTTCGAGAAG

ATGGAAATCCAATTAAAAAATGGGGACAATAAAGATACACTTATAAAGGAACAGACAGAG

TATAGAAAGGCAATACACAAAAAGTTTGCCAACGACGATCGTTTCAAGAACATGTTTAGT

GCTAAATTGATTTCAGATATTCTGCCGGAATTTGTTATTCACAACAATAATTATAGCGCC

AGTGAGAAAGAAGAAAAAACGCAGGTTATCAAACTGTTCAGTCGTTTCGCTACATCTTTT

AAGGATTACTTTAAAAACCGTGCAAATTGTTTTTCAGCCGACGATATTAGTAGCAGCTCT

TGTCACCGTATTGTTAATGATAATGCGGAGATTTTCTTTTCAAACGCATTGGTCTACAGG

AGGATAGTCAAGTCCCTTTCAAATGACGACATTAATAAGATCTCAGGTGACATGAAAGAT

TCCTTAAAGGAAATGTCCCTGGAAGAGATCTATTCCTATGAAAAGTACGGTGAGTTCATT

ACTCAAGAGGGTATAAGCTTTTACAATGACATATGTGGTAAGGTTAATAGCTTTATGAAC

CTGTATTGCCAGAAGAACAAAGAAAATAAGAATCTGTATAAGTTGCAAAAGCTACACAAA

CAAATTTTGTGCATTGCCGATACATCATACGAGGTGCCATACAAATTCGAGAGCGATGAG

GAGGTTTATCAGAGCGTGAATGGATTCCTGGACAATATTAGTAGTAAGCATATCGTGGAA

AGGCTTAGAAAGATAGGTGACAATTACAATGGCTACAATCTGGATAAAATCTACATCGTC

TCAAAATTCTATGAAAGTGTATCCCAGAAGACGTACCGTGATTGGGAAACTATCAACACC

GCTCTGGAGATACATTACAACAATATACTTCCCGGAAACGGCAAGTCAAAAGCCGACAAA

GTCAAAAAAGCGGTCAAGAACGATTTACAAAAGTCTATCACTGAAATTAATGAATTAGTT

AGTAATTACAAACTGTGTAGTGATGATAATATTAAGGCAGAGACTTACATACACGAAATT

TCACACATTTTAAACAACTTCGAGGCACAGGAACTTAAATATAATCCTGAAATTCACCTG

GTTGAAAGTGAATTGAAAGCCAGCGAGCTAAAGAACGTTTTGGACGTAATCATGAACGCA

-continued

TTCCACTGGTGCTCTGTCTTTATGACAGAGGAACTAGTGGATAAGGACAATAATTTTTAT

GCGGAGCTGGAGGAAATATACGATGAGATATATCCCGTAATATCATTATATAATCTGGTA

AGAAACTATGTGACTCAAAAGCCGTATAGCACCAAGAAAATTAAACTTAATTTCGGCATA

CCCACTTTAGCGGACGGCTGGTCAAAATCCAAAGAGTATAGTAATAATGCCATCATCCTG

ATGCGTGACAACCTGTACTATTTAGGTATATTTAACGCCAAAAATAAACCCGACAAAAAG

ATTATAGAGGGCAACACCTCAGAGAACAAAGGTGATTATAAGAAGATGATTTACAACCTT

TTACCCGGTCCTAATAAGATGATTCCCAAAGTCTTTCTATCTAGCAAAACTGGTGTTGAA

ACATACAAACCCTCAGCTTATATTTTAGAAGGGTATAAGCAGAATAAGCATATTAAAAGC

TCCAAAGATTTCGATATTACCTTTTGCCATGACTTGATAGACTATTTCAAAAATTGTATT

GCCATTCACCCTGAATGGAAAAACTTCGGATTTGACTTCTCTGACACATCCACCTACGAA

GACATTTCAGGTTTTTACAGGGAAGTCGAGCTACAGGGTTATAAAATTGATTGGACATAC

ATCAGCGAGAAAGATATTGACCTACTTCAAGAAAAAGGGCAGCTATACCTGTTCCAGATA

TACAATAAAGACTTCAGTAAAAAAAGCACCGGGAACGATAATCTTCACACAATGTACTTA

AAAAATTTATTTAGTGAAGAGAATCTGAAGGATATAGTGCTGAAGTTAAACGGGGAGGCA

GAGATATTTTTTAGAAAATCTAGTATTAAGAATCCGATCATCCACAAGAAGGGTTCTATC

CTTGTTAATAGGACTTATGAGGCAGAAGAAAAAGACCAATTCGGCAACATACAAATTGTC

CGTAAAAATATCCCTGAGAACATTTATCAGGAACTATACAAGTACTTCAATGATAAAAGC

GACAAGGAGCTGAGCGACGAGGCTGCTAAGTTAAAGAATGTGGTGGGCCACCATGAGGCA

GCAACGAATATTGTGAAGGACTATCGTTATACCTACGATAAATACTTTCTTCATATGCCG

ATCACCATTAATTTCAAGGCAAACAAAACTGGCTTCATTAACGATCGTATCTTACAATAT

ATCGCAAAAGAGAAAGACCTTCACGTTATCGGGATCGATAGAGGCGAGCGTAACCTAATT

TATGTTTCTGTGATAGACACCTGTGGGAACATAGTCGAACAGAAATCATTTAATATTGTT

AACGGCTACGATTATCAGATAAAGTTGAAGCAACAAGAGGGTGCACGTCAAATAGCAAGG

AAAGAATGGAAAGAAATAGGCAAGATTAAAGAAATAAAAGAAGGTTATTTATCCCTTGTA

ATACACGAAATTAGCAAAATGGTGATTAAATATAATGCGATCATTGCCATGGAGGATCTT

TCTTACGGCTTCAAAAAGGGGAGATTCAAAGTCGAGAGGCAGGTGTATCAGAAGTTTGAG

ACCATGCTAATCAATAAACTAAATTATCTAGTATTCAAAGACATAAGCATCACCGAAAAT

GGCGGCTTGTTGAAGGGTTATCAATTGACCTACATCCCAGATAAACTAAAAAACGTAGGG

CATCAATGCGGATGTATATTTTACGTTCCAGCCGCATACACTTCCAAAATCGATCCAACT

ACGGGTTTTGTGAACATCTTCAAATTCAAAGACTTGACTGTCGATGCTAAGAGGGAGTTT

ATCAAGAAATTTGACTCCATTAGATACGACAGTGAGAAGAATCTGTTCTGTTTTACCTTT

GATTATAACAACTTTATAACTCAAAACACAGTCATGAGTAAGTCATCTTGGTCAGTGTAT

ACGTATGGTGTGAGGATTAAAAGGAGGTTTGTTAACGGGAGATTTTCCAATGAAAGTGAT

ACAATAGATATAACCAAGGACATGGAAAAGACTCTTGAAATGACCGACATTAACTGGAGA

GATGGCCACGACTTACGTCAAGATATAATCGATTACGAGATAGTGCAACATATCTTTGAG

ATATTTAGGCTTACTGTCCAAATGCGTAACTCATTAAGTGAGTTGGAGGACAGGGATTAC

GATAGGCTAATAAGTCCTGTTCTTAACGAAAACAATATATTCTACGATTCAGCAAAGGCG

GGAGACGCCCTGCCCAAGGACGCGGATGCTAACGGCGCATACTGTATTGCCCTGAAAGGC

TTGTACGAGATAAAACAGATCACGGAGAACTGGAAAGAAGATGGAAAATTCAGTCGTGAC

AAGTTAAAAATTAGTAACAAAGACTGGTTCGACTTTATTCAGAACAAGAGATATCTGAAA

-continued

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 56
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAACAACGGA

ACCAATAACTTTCAAAACTTTATAGGCATCTCCAGTCTACAGAAGACACTACGTAACGCT

TTGATACCAACTGAGACCACGCAGCAGTTTATCGTCAAGAACGGTATTATAAAGGAAGAC

GAGCTAAGGGGGGAAAACCGTCAGATCTTAAAGGACATCATGGATGACTACTACAGAGGC

TTCATAAGTGAGACTTTGTCTAGTATAGACGACATCGACTGGACCAGTTTATTTGAGAAG

ATGGAAATTCAGTTAAAGAACGGGGACAATAAAGACACACTAATTAAAGAGCAGACCGAA

TACAGAAAAGCTATACACAAAAAGTTTGCCAACGATGATAGATTCAAAAATATGTTTTCA

GCAAAATTGATTTCCGACATATTGCCAGAATTCGTAATCCATAATAACAATTATTCTGCA

AGTGAGAAGGAAGAGAAGACCCAAGTAATCAAGCTGTTTTCCCGTTTTGCTACGAGTTTC

AAAGATTATTTCAAGAATAGGGCTAATTGTTTCTCCGCGGACGACATAAGTAGCAGTTCC

TGTCACAGGATTGTGAACGATAATGCTGAGATATTTTTTTCCAATGCCCTAGTGTATAGG

AGAATAGTTAAAAGCTTAAGCAACGACGATATCAATAAAATTTCAGGGGACATGAAGGAC

AGCTTAAAGGAAATGAGTTTGGAGGAGATTTACAGTTATGAAAAATACGGAGAGTTTATA

ACTCAGGAAGGCATCTCTTTCTATAATGATATCTGTGGGAAGGTAAACTCCTTCATGAAT

TTATATTGCCAGAAGAATAAGGAAAACAAAAATCTTTACAAGCTTCAAAAGTTACATAAG

CAGATCTTATGTATTGCCGACACGAGTTATGAAGTGCCTTATAAATTCGAGAGTGATGAG

GAAGTGTATCAGTCTGTTAACGGATTCCTAGATAATATAAGTTCCAAACATATAGTCGAG

AGGCTGAGGAAGATTGGCGATAACTATAATGGATATAATCTTGACAAAATCTATATAGTC

TCTAAATTTTATGAAAGCGTCAGCCAGAAGACATATAGAGATTGGGAAACTATAAACACA

GCCCTTGAAATACATTACAATAACATCCTACCCGGCAATGGTAAGTCTAAGGCAGACAAA

GTTAAAAAAGCAGTAAAGAATGACTTACAGAAGTCAATCACGGAGATAAATGAGTTGGTC

AGTAACTACAAATTATGCTCCGACGATAATATTAAGGCCGAAACATATATACACGAGATA

AGTCATATATTAAACAATTTCGAAGCCCAGGAGTTAAAATATAACCCTGAAATTCATCTG

GTCGAAAGTGAGTTAAAGGCCAGTGAGTTAAAGAATGTACTTGACGTAATTATGAATGCT

TTTCATTGGTGCTCCGTGTTCATGACCGAGGAGTTAGTAGATAAAGACAATAACTTTTAC

GCCGAACTTGAAGAGATATACGACGAGATTTATCCGGTAATCAGCTTGTACAACTTAGTT

AGAAATTATGTAACACAGAAGCCTTACTCTACTAAAAAAATAAAACTGAACTTTGGTATC

CCAACTCTTGCAGATGGTTGGAGTAAAAGCAAGGAATATAGCAACAATGCGATCATCTTG

ATGAGAGACAACTTGTACTATTTGGGAATCTTCAACGCGAAAAATAAACCCGACAAAAAA

ATCATCGAAGGGAATACCTCTGAGAATAAAGGTGACTATAAGAAAATGATTTACAATCTA

CTTCCTGGTCCTAATAAAATGATCCCGAAAGTGTTTCTTAGTTCTAAGACTGGTGTCGAG

ACGTACAAACCTAGCGCGTACATCTTAGAAGGGTACAAGCAGAATAAACACATCAAATCA

AGCAAAGACTTCGATATTACTTTTTGCCATGACTTGATAGACTACTTTAAAAACTGCATA

GCAATCCACCCGGAGTGGAAAAACTTTGGCTTTGATTTCTCTGACACCTCTACATATGAG

GACATATCTGGTTTTTACCGTGAGGTTGAATTGCAGGGATACAAAATTGACTGGACTTAC

ATATCTGAAAAAGATATCGATCTATTGCAGGAGAAAGGCCAGCTTTACCTTTTCCAGATC

-continued

TATAATAAGGACTTCTCTAAGAAGTCTACAGGGAATGATAATTTGCACACTATGTACTTA

AAAAATCTGTTTTCCGAGGAAAACTTGAAAGACATTGTTTTAAAGTTGAACGGAGAAGCT

GAAATATTTTTCAGAAAGAGCTCCATAAAAAACCCGATCATTCATAAGAAGGGATCTATC

CTGGTTAACAGAACGTACGAAGCGGAAGAAAAAGACCAATTCGGAAACATTCAAATTGTT

AGAAAGAATATCCCTGAGAACATCTACCAGGAGTTATATAAGTATTTTAATGATAAGTCA

GATAAGGAACTATCTGACGAAGCGGCGAAGCTTAAAAATGTTGTAGGACACCATGAGGCT

GCTACAAATATAGTCAAGGACTACCGTTATACCTACGATAAGTACTTTCTACACATGCCC

ATTACCATCAATTTTAAAGCTAATAAAACGGGTTTTATCAACGATCGTATCCTACAATAT

ATTGCGAAAGAGAAGGATTTGCATGTCATTGGCATTGATAGAGGTGAGAGGAACCTAATA

TACGTATCCGTGATTGATACGTGCGGGAACATAGTTGAACAGAAATCATTTAATATAGTT

AATGGGTACGACTATCAGATTAAGCTAAAGCAACAAGAAGGCGCCAGGCAAATTGCCCGT

AAAGAATGGAAAGAGATCGGGAAGATCAAGGAAATAAAAGAAGGATACCTTTCCCTGGTC

ATCCATGAAATTAGCAAAATGGTGATTAAGTACAATGCCATAATCGCGATGGAGGACTTA

AGCTACGGGTTCAAAAAGGGGAGGTTTAAGGTGGAGAGGCAAGTGTACCAGAAATTTGAG

ACCATGCTAATCAACAAACTGAACTACCTAGTTTTTAAGGACATTTCAATTACAGAGAAT

GGAGGACTTTTAAAGGGTTACCAACTAACGTATATACCAGATAAGTTGAAAAATGTCGGT

CACCAGTGTGGCTGCATCTTTTACGTTCCCGCCGCTTATACATCTAAAATTGATCCAACC

ACAGGCTTTGTAAATATCTTTAAATTCAAAGATTTAACTGTGGATGCAAAAAGAGAGTTT

ATCAAGAAATTCGATAGCATTCGTTATGATAGCGAGAAGAACCTGTTCTGCTTTACTTTC

GACTATAACAACTTTATAACTCAAAACACCGTGATGTCAAAAAGCTCATGGTCAGTCTAC

ACCTATGGTGTAAGGATTAAAAGGCGTTTCGTGAATGGGAGATTCTCCAATGAAAGTGAC

ACGATCGACATAACAAAGGACATGGAGAAGACACTAGAGATGACTGATATTAATTGGAGA

GACGGACACGATCTGCGTCAAGATATAATTGATTATGAGATAGTACAGCACATATTTGAG

ATCTTCCGTTTGACTGTCCAAATGCGTAATTCCCTTTCTGAGCTGGAAGATAGGGACTAT

GATAGATTAATATCCCCTGTACTAAATGAGAACAACATTTTCTATGATAGTGCAAAAGCC

GGGGATGCATTGCCGAAAGACGCTGACGCTAATGGGGCGTACTGTATAGCTTTAAAGGGG

CTTTACGAAATAAAGCAGATAACCGAAAACTGGAAGGAAGATGGCAAATTCTCAAGGGAC

AAACTTAAGATCTCTAACAAGGATTGGTTCGATTTTATACAAAACAAACGTTATTTGAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 57
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAATAATGGT

ACAAACAACTTTCAGAATTTCATTGGGATCTCTAGCTTACAGAAGACCCTGAGGAATGCG

TTGATTCCAACTGAAACAACCCAGCAATTCATCGTGAAAAATGGGATAATCAAAGAGGAT

GAGTTAAGGGGTGAAAACCGTCAAATATTGAAGGATATTATGGACGACTACTACCGTGGA

TTCATCTCAGAGACGTTGAGCAGCATTGACGACATAGACTGGACTAGCCTTTTCGAGAAG

ATGGAAATTCAGTTAAAGAACGGAGATAACAAAGATACACTAATCAAGGAACAGACAGAA

TACAGAAAAGCAATTCATAAGAAATTCGCTAATGACGATCGTTTTAAAAACATGTTCTCT

GCAAAATTAATTAGCGACATTCTGCCGGAATTCGTTATACATAATAATAACTACAGTGCT

-continued

TCTGAAAAGGAAGAGAAAACTCAGGTAATAAAACTGTTCTCTCGTTTTGCCACATCCTTC

AAAGACTACTTTAAAAATAGAGCGAACTGCTTTAGCGCCGACGATATTAGTTCTTCCTCA

TGCCACAGGATTGTCAACGATAATGCAGAGATATTCTTTTCTAACGCACTAGTCTACAGA

AGGATTGTAAAGTCTTTGTCAAATGATGACATAAACAAGATTAGTGGAGATATGAAAGAC

TCTCTAAAGGAAATGAGCCTTGAGGAGATATACTCTTATGAAAAGTACGGTGAGTTTATT

ACCCAAGAAGGCATTAGTTTCTATAATGACATTTGTGGAAAAGTTAACAGTTTTATGAAT

CTATACTGTCAAAAAAATAAGGAGAATAAAAATCTTTATAAGTTGCAAAAACTGCATAAG

CAGATATTATGTATAGCAGACACGAGCTATGAGGTACCGTACAAGTTCGAGAGCGATGAG

GAAGTCTACCAATCTGTCAACGGATTTTTGGACAACATTTCTTCAAAACATATTGTGGAG

AGGCTTAGGAAAATAGGCGACAATTATAATGGATATAACTTAGATAAGATATATATTGTT

TCCAAATTCTACGAATCTGTAAGCCAGAAGACATACAGAGATTGGGAAACGATAAACACA

GCCCTTGAAATTCACTATAACAACATACTACCTGGAAACGGCAAATCAAAGGCCGACAAA

GTTAAGAAGGCCGTAAAGAATGATTTACAGAAGAGCATAACGGAGATCAATGAGCTGGTG

TCTAACTATAAATTGTGTAGCGATGACAACATAAAAGCCGAGACTTACATTCACGAAATT

TCACACATACTTAACAACTTTGAAGCTCAGGAATTAAAGTATAATCCCGAAATACACCTT

GTGGAGTCCGAACTAAAGGCTAGTGAGCTTAAGAACGTCCTAGACGTAATTATGAATGCC

TTCCACTGGTGTAGTGTTTTTATGACCGAGGAACTTGTTGACAAAGATAATAATTTTTAT

GCAGAACTAGAAGAGATATACGATGAAATATACCCGGTGATCAGTTTGTACAATCTTGTC

AGGAACTATGTGACACAAAAGCCCTATTCAACAAAGAAAATAAAACTTAATTTCGGAATT

CCTACGTTAGCTGATGGCTGGTCTAAATCCAAGGAATACAGCAACAACGCTATAATTCTG

ATGAGAGATAACTTGTACTATCTAGGCATCTTCAATGCCAAAAATAAGCCTGATAAGAAG

ATTATAGAGGGCAACACTTCAGAGAACAAGGGCGACTACAAGAAAATGATCTATAACCTA

TTGCCTGGCCCAAACAAGATGATTCCGAAGGTCTTCCTATCATCCAAGACCGGCGTTGAG

ACATACAAGCCATCAGCGTATATTTTAGAGGGGTACAAACAAAACAAGCACATAAAGTCT

AGTAAAGACTTCGATATAACATTTTGTCATGACTTAATTGACTACTTTAAGAATTGCATC

GCTATACACCCGGAATGGAAGAATTTCGGCTTCGACTTCTCTGATACATCTACCTACGAG

GACATTAGCGGGTTTTACCGTGAAGTCGAATTACAAGGGTATAAGATAGATTGGACGTAC

ATCTCTGAGAAAGACATAGACTTGCTTCAGGAAAAGGGCCAGTTGTATCTATTCCAAATA

TACAATAAGGATTTTTCCAAGAAATCTACGGGTAATGACAATCTTCACACAATGTATCTT

AAGAACCTTTTCTCAGAAGAGAACCTGAAGGACATTGTCTTAAAACTAAATGGCGAAGCT

GAGATTTTTTTCAGGAAGTCTTCAATTAAGAACCCGATAATCCACAAGAAGGGGAGTATT

CTTGTGAATAGAACTTACGAGGCCGAAGAAAAAGACCAATTTGGTAACATCCAGATAGTC

AGAAAGAACATTCCAGAGAACATCTACCAAGAGCTATACAAATATTTCAACGACAAGTCC

GATAAGGAACTGTCCGATGAGGCAGCCAAGTTGAAGAATGTCGTGGGTCATCATGAAGCT

GCTACTAACATTGTCAAGGACTATCGTTATACTTACGACAAGTATTTCCTACACATGCCG

ATAACAATTAATTTCAAGGCTAACAAAACAGGCTTTATCAACGATCGTATCTTGCAGTAC

ATAGCTAAGGAAAAGGATTTGCATGTGATTGGCATTGATAGAGGGGAGCGTAACTTGATA

TATGTGTCTGTCATAGACACGTGTGGCAACATCGTCGAACAGAAATCATTCAACATAGTA

AACGGCTACGATTACCAAATTAAGCTGAAACAGCAAGAGGGTGCACGTCAAATTGCGCGT

AAAGAGTGGAAAGAAATTGGTAAAATCAAGGAAATTAAAGAAGGCTACTTGTCTCTTGTT

ATACATGAAATTTCCAAGATGGTTATAAAGTATAACGCGATAATTGCTATGGAAGACTTA

-continued

TCATACGGGTTTAAAAAGGGGAGGTTCAAGGTAGAGAGGCAGGTCTATCAAAAGTTCGAG

ACGATGTTGATTAATAAACTAAACTATCTAGTGTTCAAAGATATCAGCATTACGGAGAAC

GGGGGGCTACTGAAAGGATATCAACTAACGTACATTCCCGATAAGTTAAAGAACGTTGGT

CATCAATGTGGTTGCATCTTCTACGTGCCTGCTGCCTATACGTCCAAAATAGATCCAACT

ACTGGATTTGTTAACATCTTTAAATTCAAAGATTTAACCGTAGACGCCAAAAGGGAATTT

ATAAAAAAATTTGACAGCATCCGTTACGATAGCGAAAAGAATCTGTTCTGTTTTACTTTC

GACTACAATAATTTCATCACGCAAAATACGGTAATGTCTAAGTCAAGTTGGAGCGTCTAC

ACGTATGGAGTCAGGATCAAGAGGCGTTTCGTAAATGGAAGATTCTCTAATGAGTCAGAT

ACTATAGACATCACGAAAGATATGGAGAAAACCTTGGAGATGACGGATATTAACTGGCGT

GATGGACACGATTTAAGACAGGACATTATTGACTATGAGATTGTGCAACACATCTTCGAA

ATATTCCGTCTAACAGTCCAAATGAGGAATAGCCTAAGTGAATTGGAGGACCGTGATTAC

GATAGGCTTATAAGTCCTGTCCTTAACGAAAACAATATTTTCTATGATAGTGCTAAGGCG

GGGGACGCACTGCCTAAAGACGCAGATGCTAACGGGGCATACTGCATTGCGTTAAAGGGT

CTGTACGAAATCAAGCAGATTACGGAAAACTGGAAAGAGGATGGCAAGTTTAGCAGAGAT

AAGTTGAAGATAAGTAACAAAGATTGGTTTGACTTTATTCAGAATAAAAGGTATTTAAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 58
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAATAACGGC

ACTAATAATTTCCAGAATTTCATCGGCATTAGCAGCTTACAAAAGACGTTGAGGAATGCC

TTAATACCCACAGAAACTACTCAACAATTTATAGTGAAGAATGGGATAATTAAGGAAGAC

GAGTTGAGAGGTGAAAATAGGCAAATCTTGAAAGACATTATGGATGACTACTACAGGGGC

TTCATTAGTGAAACGTTGTCTTCAATAGATGACATTGATTGGACTTCTTTGTTTGAGAAG

ATGGAAATACAGTTAAAGAACGGCGACAATAAGGATACACTTATCAAAGAGCAAACAGAA

TATAGAAAAGCAATTCACAAAAAGTTTGCTAACGATGATAGGTTCAAGAACATGTTTAGC

GCTAAACTAATATCAGACATCCTTCCCGAGTTCGTTATTCATAACAATAACTATAGTGCA

AGTGAAAAAGAGGAGAAGACACAGGTGATTAAGCTGTTCTCCAGATTCGCGACTTCTTTC

AAAGATTACTTCAAAAACAGAGCCAACTGTTTTTCAGCTGACGATATCTCTAGTAGTAGT

TGTCACCGTATAGTGAACGATAACGCTGAGATCTTCTTTAGCAATGCATTAGTGTATAGA

AGGATAGTTAAGTCTCTAAGCAATGATGATATCAATAAAATTTCCGGAGACATGAAGGAC

TCCCTAAAGGAAATGTCCTTAGAAGAGATCTACTCATATGAGAAATACGGGGAATTTATT

ACGCAGGAAGGGATCTCCTTTTACAATGACATATGCGGGAAGGTCAACTCTTTCATGAAC

TTATACTGCCAAAAGAACAAGGAGAACAAGAATTTATATAAACTTCAGAAACTTCACAAA

CAAATACTGTGCATAGCCGATACCTCATATGAGGTTCCTTACAAATTTGAATCAGATGAA

GAGGTATACCAATCCGTTAACGGCTTTCTTGACAATATTAGCTCAAAGCACATCGTGGAG

AGGTTGAGAAAGATTGGTGATAATTATAATGGCTACAATCTAGATAAGATATATATTGTT

AGCAAGTTCTACGAGTCTGTGTCCCAAAAAACATATAGGGATTGGGAGACAATTAATACT

GCTCTAGAAATCCATTACAACAACATCCTTCCTGGAAATGGCAAGAGTAAGGCCGACAAA

GTCAAGAAAGCAGTGAAAAATGATCTGCAAAAATCAATTACTGAGATAAACGAGCTAGTA

-continued

TCTAATTACAAGCTTTGTAGCGACGATAACATTAAGGCAGAAACGTACATACACGAGATT
AGTCACATCTTAAATAATTTTGAAGCCCAAGAACTGAAATATAACCCTGAGATACACCTT
GTTGAATCCGAGTTAAAGGCGTCTGAACTAAAAAACGTGTTAGACGTTATTATGAATGCC
TTCCACTGGTGTAGCGTCTTTATGACTGAGGAGTTGGTTGATAAGGATAATAACTTTTAC
GCTGAATTGGAAGAAATTTATGACGAAATCTATCCTGTTATTTCTCTATATAATTTGGTG
AGAAATTACGTAACGCAAAAGCCCTATAGTACGAAAAAAATAAAACTAAATTTCGGGATC
CCTACCCTAGCCGACGGTTGGTCTAAATCCAAGGAGTACTCAAACAATGCAATAATATTG
ATGAGGGACAACCTGTACTACCTAGGCATATTTAATGCCAAAAATAAGCCCGATAAAAAG
ATTATAGAAGGGAACACGTCAGAAAATAAAGGAGACTATAAGAAAATGATCTACAACCTT
TTGCCCGGCCCCAATAAAATGATCCCGAAGGTCTTCCTAAGTAGCAAGACTGGCGTAGAG
ACCTACAAACCATCTGCATACATTTTGGAGGGGTACAAGCAAAACAAGCACATAAAGAGT
AGTAAGGATTTTGACATTACATTCTGCCATGACTTAATTGACTACTTTAAAAATTGCATC
GCAATTCACCCTGAATGGAAAAATTTTGGATTTGATTTCTCTGATACTTCAACATATGAG
GATATTTCAGGGTTCTACAGGGAGGTCGAACTACAGGGTTACAAAATAGACTGGACGTAT
ATTTCTGAGAAAGATATAGATTTGCTTCAGGAAAAGGGTCAGCTATATCTGTTCCAGATA
TATAATAAGGACTTCTCCAAAAAGAGTACCGGAAATGATAATCTGCACACAATGTACTTA
AAAAACTTGTTCTCTGAGGAGAATCTAAAAGACATCGTACTAAAACTTAACGGGGAGGCC
GAAATTTTTTTTAGGAAGTCCAGCATCAAGAACCCGATTATTCATAAAAAAGGTAGCATT
TTGGTGAACCGTACTTATGAGGCGGAAGAAAAAGACCAATTCGGTAATATTCAAATCGTT
AGAAAGAACATCCCTGAGAACATTTATCAGGAACTATACAAATACTTTAACGACAAATCA
GATAAGGAGCTTTCTGATGAGGCAGCTAAATTGAAAAATGTAGTGGGACATCACGAAGCA
GCCACTAACATAGTGAAGGACTACAGATACACATACGATAAGTACTTCCTGCACATGCCT
ATTACAATTAACTTTAAAGCAAATAAAACAGGGTTTATTAACGACAGAATCTTACAGTAT
ATTGCCAAAGAAAAGGATCTGCATGTGATAGGAATAGACAGAGGAGAAAGAAACCTGATA
TACGTCTCCGTGATTGATACATGTGGGAACATAGTAGAACAGAAGTCCTTTAACATTGTT
AATGGGTACGATTATCAAATTAAATTAAAACAACAAGAAGGAGCACGTCAAATAGCTAGG
AAAGAATGGAAAGAGATAGGAAAAATTAAGGAAATTAAGGAGGGTTACCTGTCCCTTGTA
ATTCATGAAATATCCAAAATGGTAATTAAATATAACGCGATCATCGCGATGGAAGATCTA
AGCTACGGGTTCAAAAAAGGCAGGTTTAAGGTGGAGAGGCAAGTTTACCAAAAGTTCGAG
ACAATGTTGATTAATAAGTTAAACTACTTAGTTTTCAAAGATATCTCCATAACCGAGAAT
GGCGGGCTTTTAAAAGGGTACCAACTAACATATATCCCGGATAAATTGAAGAACGTTGGA
CACCAGTGTGGCTGCATATTTTATGTACCCGCTGCGTATACTTCTAAAATTGACCCGACC
ACCGGGTTTGTAAACATATTCAAGTTTAAGGACCTAACAGTTGACGCCAAACGTGAGTTC
ATCAAGAAGTTCGATAGTATAAGGTATGACTCTGAGAAGAACCTTTTCTGCTTCACGTTT
GACTATAATAATTTCATCACCCAAAATACAGTTATGTCAAAAAGCTCTTGGTCAGTATAT
ACGTATGGCGTAAGGATTAAGCGTAGGTTCGTGAACGGTAGATTTTCCAACGAGTCAGAT
ACTATTGATATTACCAAGGATATGGAGAAGACATTAGAAATGACAGATATAAATTGGAGG
GATGGGCACGATCTAAGGCAAGATATCATTGATTACGAAATTGTTCAGCACATATTCGAG
ATATTCCGTCTTACAGTACAAATGCGTAACAGCTTGTCTGAGTTGGAAGATCGTGACTAT
GACAGGTTGATATCACCGGTCTTGAACGAGAACAATATATTCTACGACAGCGCTAAGGCG

-continued

GGAGACGCTCTGCCTAAAGACGCAGATGCCAATGGGGCGTACTGCATTGCCTTAAAAGGC

TTATACGAGATTAAACAGATCACAGAGAACTGGAAAGAGGACGGCAAGTTTTCTAGAGAT

AAATTGAAAATCTCAAACAAAGACTGGTTCGATTTCATCCAAAACAAAAGATACCTTAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 59

ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAACAATGGA

ACTAACAACTTCCAGAACTTTATCGGCATCTCTTCCCTCCAAAAGACACTGAGAAATGCA

CTGATCCCAACCGAAACGACTCAACAATTTATTGTTAAGAACGGCATCATAAAAGAAGAC

GAGCTTCGCGGCGAGAACCGCCAGATACTTAAGGATATTATGGACGATTATTACCGAGGC

TTTATCAGCGAAACTCTTAGCTCTATTGATGATATCGACTGGACCTCCCTCTTCGAAAAA

ATGGAGATACAGCTCAAGAACGGCGATAATAAAGACACCTTGATAAAGGAACAGACTGAG

TACAGGAAAGCGATCCACAAGAAATTCGCGAACGACGACAGGTTTAAAAACATGTTCTCT

GCAAAATTGATATCCGACATCTTGCCGGAATTTGTGATACACAACAATAACTATAGCGCT

TCAGAGAAAGAAGAGAAGACCCAAGTAATCAAGTTGTTCAGCCGCTTCGCAACGTCTTTT

AAAGATTACTTTAAGAACCGGGCCAATTGTTTCTCCGCGGATGATATTAGCTCATCAAGT

TGCCATCGAATTGTCAATGATAATGCGGAGATCTTCTTCAGCAATGCGCTGGTCTACAGA

CGAATCGTAAAAAGTCTTTCAAATGACGACATCAATAAGATTAGTGGAGATATGAAGGAT

TCCCTTAAGGAAATGAGTCTTGAAGAAATATACTCATACGAAAAGTACGGGGAATTTATT

ACCCAGGAGGGGATCTCCTTCTATAACGACATCTGTGGAAAAGTAAACTCATTCATGAAC

CTGTACTGTCAGAAAAACAAAGAAAACAAAAATCTGTATAAACTCCAAAAATTGCACAAG

CAAATATTGTGTATAGCGGACACATCATACGAGGTTCCATATAAGTTCGAAAGTGATGAA

GAAGTCTACCAATCAGTGAATGGGTTTCTGGACAACATTAGTTCCAAGCACATAGTTGAA

CGACTGCGAAAGATTGGTGACAATTACAACGGCTATAATTTGGACAAGATTTATATAGTT

AGCAAATTTTATGAATCCGTATCACAAAAGACTTATAGAGACTGGGAAACAATCAACACG

GCACTTGAGATCCATTATAACAATATTCTTCCAGGGAACGGCAAAAGCAAGGCTGATAAG

GTAAAAAAGGCCGTTAAGAATGATCTTCAAAAATCCATAACGGAGATCAACGAACTTGTA

AGTAACTACAAATTGTGCTCTGACGACAATATAAAGGCTGAAACGTATATTCACGAGATT

AGCCATATCCTGAATAACTTTGAGGCCCAAGAACTCAAGTATAACCCGGAAATACATTTG

GTAGAAAGCGAGCTTAAAGCGAGTGAGCTGAAAAACGTCCTCGATGTGATCATGAATGCT

TTCCACTGGTGTAGTGTCTTTATGACTGAGGAGTTGGTTGATAAAGACAATAATTTCTAC

GCTGAACTGGAAGAAATTTACGACGAAATCTATCCAGTGATCTCCCTCTATAACCTCGTT

CGAAACTACGTGACGCAGAAACCTTATTCTACAAAGAAAATTAAGTTGAACTTCGGCATT

CCTACACTTGCTGACGGATGGTCCAAATCCAAAGAGTACTCAAACAACGCAATCATCCTC

ATGCGGGATAACCTTTATTATTTGGGCATTTTCAACGCCAAAAACAAACCTGATAAAAAG

ATAATTGAAGGCAATACGAGTGAGAACAAGGGCGACTACAAAAAAATGATATATAACTTG

TTGCCAGGCCCCAACAAGATGATTCCTAAAGTTTTTCTGTCTTCTAAGACTGGAGTTGAA

ACTTACAAACCCTCCGCCTACATTCTTGAAGGGTATAAACAGAATAAGCACATAAAGTCC

TCAAAGGATTTCGACATTACGTTTTGCCATGACCTCATCGACTATTTCAAGAACTGTATC

-continued

GCCATACATCCGGAGTGGAAGAATTTTGGATTTGATTTCTCCGACACATCTACCTATGAA

GACATAAGCGGTTTCTACCGGGAGGTCGAGCTTCAGGGCTATAAGATAGATTGGACATAC

ATTAGTGAAAAAGATATCGATCTTCTGCAAGAAAAGGGACAACTTTACCTTTTTCAGATT

TATAATAAAGACTTTTCAAAAAAGTCCACAGGGAACGATAATCTGCACACCATGTATCTC

AAGAATCTGTTTAGTGAAGAAAACCTTAAAGACATAGTTTTGAAGCTTAACGGAGAGGCT

GAGATTTTTTTTAGAAAGTCCTCAATTAAAAACCCTATAATACACAAGAAAGGCTCTATT

CTTGTTAACAGGACATATGAAGCCGAGGAGAAAGATCAGTTTGGCAATATCCAGATTGTT

CGCAAGAATATCCCGGAAAATATATATCAGGAGCTGTATAAATACTTTAACGACAAGAGC

GACAAGGAGCTGAGTGACGAGGCCGCGAAGCTTAAGAATGTAGTAGGTCACCACGAAGCA

GCCACCAATATCGTCAAAGACTATAGGTACACGTACGACAAGTACTTTTTGCACATGCCT

ATAACTATAAACTTCAAAGCTAATAAAACTGGGTTTATTAATGACAGGATTCTCCAATAC

ATCGCTAAAGAGAAGGATCTGCATGTAATTGGCATAGACAGAGGTGAGAGAAACTTGATA

TATGTCAGCGTAATAGACACATGTGGCAATATCGTGGAACAGAAGTCTTTTAACATCGTC

AATGGTTACGACTACCAAATTAAGTTGAAACAGCAGGAAGGCGCACGACAGATCGCACGA

AAGGAATGGAAAGAGATAGGCAAAATAAAAGAAATAAAGGAGGGCTATCTCAGTCTCGTT

ATACACGAAATTTCAAAAATGGTTATTAAGTACAATGCAATCATAGCGATGGAGGATCTC

AGTTATGGGTTCAAAAAGGGTCGGTTTAAAGTTGAGCGCCAAGTGTACCAAAAGTTCGAG

ACAATGCTGATTAACAAGCTGAACTACCTCGTCTTCAAAGATATAAGTATTACGGAGAAC

GGTGGCCTTCTTAAAGGCTATCAACTTACTTACATCCCGGACAAGCTCAAAAACGTAGGG

CACCAATGCGGGTGTATTTTCTATGTGCCTGCGGCATATACGTCAAAGATTGACCCAACC

ACAGGATTCGTAAACATATTCAAGTTTAAGGACCTCACCGTTGATGCGAAAAGGGAGTTC

ATTAAAAAATTTGATTCTATTCGATATGATAGTGAGAAAAATCTCTTTTGTTTCACATTT

GACTATAATAATTTTATTACTCAGAATACTGTCATGAGCAAGTCATCTTGGTCAGTGTAC

ACATACGGGGTGCGGATCAAACGCAGGTTCGTCAATGGTCGCTTCTCAAACGAATCAGAC

ACCATTGACATCACAAAGGACATGGAAAAAACCCTTGAGATGACCGACATTAATTGGCGC

GATGGTCATGATCTGCGGCAAGACATCATAGACTACGAAATCGTCCAACACATCTTTGAG

ATCTTTCGCTTGACGGTCCAAATGCGGAACTCCCTGTCCGAGCTCGAGGATAGAGATTAT

GATCGGCTGATATCTCCCGTGCTTAATGAAAATAACATCTTCTACGACTCCGCCAAGGCG

GGTGATGCCCTGCCGAAGGATGCGGATGCTAATGGCGCTTATTGCATTGCTCTTAAGGGG

CTCTATGAGATAAAGCAGATCACGGAAAACTGGAAAGAAGACGGTAAGTTTAGTAGAGAC

AAGCTGAAGATCTCAAATAAAGACTGGTTTGATTTCATACAGAACAAGCGGTACCTGAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 60
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAACAATGGC

ACTAACAATTTTCAGAATTTCATCGGCATTTCAAGTCTGCAAAAAACTCTGAGGAATGCT

TTGATCCCTACTGAAACCACTCAGCAATTTATAGTCAAGAACGGTATAATTAAAGAAGAT

GAACTCAGGGGTGAAAATAGACAAATACTCAAGGACATTATGGATGACTATTATAGAGGC

TTCATCTCAGAGACTCTCTCATCAATAGATGATATCGATTGGACTAGCCTTTTCGAGAAA

-continued

ATGGAGATTCAGTTGAAAAATGGTGATAACAAAGATACGTTGATAAAGGAACAGACCGAG

TACAGGAAAGCCATTCATAAGAAATTTGCTAATGACGATAGATTTAAGAATATGTTTAGT

GCAAAACTGATTAGTGACATTCTGCCGGAGTTCGTTATCCATAATAATAACTACTCTGCA

TCCGAAAAGGAGGAAAAGACGCAAGTTATTAAACTGTTCAGCCGCTTCGCCACAAGCTTC

AAGGACTACTTCAAAAATAGAGCCAACTGCTTTTCTGCCGACGATATATCATCATCTTCA

TGCCATCGGATCGTTAACGATAACGCCGAGATATTCTTCAGCAACGCCCTTGTATATCGA

AGAATAGTCAAAAGTCTGAGTAATGATGATATTAATAAAATTAGCGGTGATATGAAAGAC

TCCCTGAAGGAAATGTCACTGGAGGAAATTTATAGTTACGAAAAGTACGGCGAATTCATT

ACTCAAGAAGGCATATCCTTCTATAACGACATTTGCGGAAAGGTCAACTCATTCATGAAC

CTTTATTGCCAGAAGAATAAGGAGAATAAAAATCTTTACAAATTGCAAAAACTTCACAAA

CAAATTCTTTGCATCGCGGATACGTCCTACGAAGTTCCTTACAAATTTGAATCCGATGAG

GAAGTGTATCAGAGTGTCAATGGATTTTTGGATAATATCTCTTCAAAACATATTGTGGAG

AGATTGCGCAAAATAGGTGATAACTACAATGGCTACAACCTGGACAAGATTTATATTGTT

AGCAAGTTCTATGAAAGTGTCAGTCAAAAGACCTACAGAGATTGGGAGACAATCAACACG

GCGCTCGAAATACACTACAATAACATCCTCCCCGGCAATGGGAAGAGTAAAGCCGATAAG

GTTAAAAAAGCTGTTAAGAACGACCTCCAGAAATCCATCACGGAAATAAACGAGCTGGTT

TCCAACTATAAGCTGTGTAGCGATGATAATATTAAGGCTGAGACATATATACATGAGATC

AGCCACATTCTCAACAATTTCGAGGCACAGGAACTCAAATACAATCCCGAGATTCACTTG

GTGGAAAGTGAGTTGAAGGCGTCAGAGCTTAAGAATGTACTTGACGTAATAATGAATGCT

TTTCATTGGTGCTCCGTGTTCATGACTGAGGAACTCGTGGATAAGGATAATAACTTTTAT

GCGGAGTTGGAAGAGATATACGATGAAATATACCCGGTTATCTCACTGTATAATCTGGTC

AGAAATTACGTGACCCAAAAGCCTTATAGTACAAAAAAAATAAAGTTGAACTTCGGTATT

CCGACATTGGCAGATGGTTGGTCCAAAAGCAAAGAATACTCTAATAACGCCATTATATTG

ATGCGAGACAATTTGTATTACCTTGGGATCTTTAACGCGAAAAACAAACCGGATAAGAAG

ATCATCGAAGGTAATACATCTGAGAATAAGGGGGATTACAAGAAGATGATTTATAATCTG

TTGCCGGGGCCAAACAAGATGATTCCGAAGGTCTTTCTGTCATCTAAGACAGGAGTAGAG

ACCTACAAACCTTCTGCGTACATTTTGGAAGGCTACAAACAGAACAAGCATATAAAATCT

AGCAAGGACTTTGATATCACGTTTTGTCATGATCTGATAGATTATTTCAAAAACTGCATC

GCTATACATCCTGAGTGGAAGAATTTCGGCTTTGACTTTTCTGACACCAGCACATACGAA

GACATCTCAGGTTTCTACCGGGAAGTCGAGCTCCAGGGGTACAAGATTGACTGGACATAT

ATAAGTGAAAAAGACATCGACCTCCTCCAAGAGAAGGGCCAACTTTACCTGTTCCAGATC

TATAACAAAGACTTTTCTAAAAAGTCCACGGGTAACGACAACTTGCACACTATGTATCTG

AAAAACTTGTTCTCTGAAGAGAACCTCAAGGACATCGTCCTGAAGCTTAACGGGGAGGCG

GAGATCTTCTTTAGAAAGTCCTCTATCAAAAATCCCATTATCCATAAAAAGGGCTCTATA

CTCGTTAATAGGACATATGAAGCGGAGGAAAAAGATCAATTTGGGAACATCCAGATCGTC

CGGAAAAATATACCTGAGAATATCTATCAAGAGCTGTACAAGTATTTTAATGATAAGTCA

GACAAAGAGCTCAGTGATGAGGCGGCAAAGCTCAAGAACGTGGTGGGGCATCATGAAGCT

GCGACGAACATTGTCAAAGATTATAGATACACTTACGATAAATACTTCCTCCACATGCCG

ATAACGATTAACTTCAAAGCCAATAAGACGGGGTTTATAAATGATCGGATCCTTCAGTAC

ATTGCGAAAGAGAAAGACCTCCATGTGATCGGAATTGACCGAGGAGAAAGGAATCTGATT

TACGTGTCCGTGATTGATACTTGCGGGAATATAGTCGAGCAAAAGAGTTTCAACATAGTC

-continued

AACGGGTATGACTATCAGATAAAGCTCAAACAGCAGGAAGGTGCGAGGCAAATTGCGCGC

AAAGAGTGGAAGGAGATAGGCAAGATTAAAGAAATCAAGGAAGGTTATCTCAGCTTGGTG

ATCCATGAAATATCTAAGATGGTTATAAAGTACAATGCCATAATAGCCATGGAGGATCTT

TCCTACGGGTTTAAGAAGGGCCGATTTAAAGTGGAGCGACAAGTTTACCAGAAGTTCGAA

ACCATGTTGATTAACAAACTTAACTATTTGGTGTTCAAGGATATAAGTATAACCGAAAAC

GGCGGTTTGCTTAAGGGTTATCAGCTCACGTATATTCCTGATAAACTTAAAAACGTTGGA

CACCAGTGTGGATGTATCTTCTACGTGCCAGCCGCTTACACTAGTAAGATAGATCCTACC

ACGGGGTTTGTGAATATTTTTAAGTTTAAAGACTTGACAGTCGACGCCAAAAGGGAATTT

ATAAAAAAGTTTGATTCTATCCGCTACGATAGTGAAAAAAATCTCTTTTGCTTTACTTTC

GACTATAACAACTTCATTACGCAGAACACTGTCATGAGTAAGTCCAGCTGGAGCGTCTAC

ACATATGGCGTCCGAATTAAACGACGATTTGTAAACGGGCGGTTTTCAAACGAATCTGAC

ACGATAGACATTACCAAGGATATGGAGAAGACACTTGAGATGACCGACATAAACTGGCGG

GACGGTCACGATCTTCGGCAGGACATAATTGATTACGAAATCGTCCAGCATATATTCGAA

ATATTTCGACTTACAGTGCAAATGCGGAACAGTCTCTCTGAACTGGAAGATCGCGATTAT

GACCGGTTGATTTCTCCGGTCCTCAATGAAAATAACATATTTTATGATAGTGCTAAGGCA

GGTGATGCGTTGCCAAAGGATGCAGACGCTAATGGTGCCTATTGTATCGCGCTCAAGGGA

TTGTACGAGATAAAGCAAATTACGGAGAACTGGAAGGAGGATGGTAAGTTTAGCCGAGAC

AAGTTGAAGATTAGCAATAAAGACTGGTTTGATTTTATCCAAAACAAGAGGTACCTGAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 61
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAATAACGGA

ACTAATAACTTTCAAAATTTCATAGGTATTTCAAGCTTGCAGAAGACCCTGAGGAATGCC

CTGATTCCAACCGAGACAACGCAGCAGTTCATAGTCAAAAATGGCATTATTAAGGAAGAT

GAGCTGCGGGGGGAAAACCGACAGATACTCAAGGATATTATGGACGACTATTACCGGGGA

TTTATCTCAGAAACGCTGAGCAGTATTGATGACATCGATTGGACCAGTCTTTTCGAGAAA

ATGGAAATTCAACTTAAGAATGGTGACAATAAAGACACTCTCATAAAGGAGCAAACTGAA

TACCGAAAAGCCATACACAAAAAGTTTGCCAACGATGACCGCTTTAAAAACATGTTTTCA

GCTAAGCTCATTAGCGACATTCTCCCCGAGTTTGTGATTCATAACAATAACTATAGCGCA

TCCGAGAAGGAGGAAAAAACCCAAGTTATCAAATTGTTCAGTAGATTCGCTACGAGCTTT

AAAGATTACTTTAAAAACCGGGCTAACTGCTTCAGTGCAGACGATATCAGCTCCTCATCC

TGTCATCGCATCGTCAATGATAATGCTGAGATCTTCTTTTCTAATGCACTGGTTTACCGC

AGGATAGTTAAGTCTCTTAGTAACGACGACATCAACAAGATATCAGGAGATATGAAGGAT

TCCCTTAAAGAAATGAGTCTCGAGGAGATATATTCTTATGAAAAATACGGCGAATTTATT

ACCCAAGAGGGCATTAGTTTCTATAATGACATATGCGGAAAAGTTAATAGTTTTATGAAT

CTCTATTGTCAGAAGAATAAGGAGAATAAGAACCTCTACAAATTGCAGAAGTTGCACAAG

CAAATTCTGTGTATCGCGGACACCTCTTACGAGGTCCCATATAAGTTCGAGAGTGATGAA

GAAGTATACCAGAGCGTTAATGGGTTCCTGGACAACATCTCAAGTAAACACATAGTCGAA

AGGCTCCGAAAGATCGGTGATAACTATAACGGATATAATTTGGATAAAATTTATATAGTT

-continued

AGCAAATTTTACGAGAGCGTCAGTCAGAAGACCTACCGGGACTGGGAGACCATAAACACA

GCGCTGGAAATACATTATAACAACATACTGCCTGGGAACGGTAAGTCAAAGGCAGACAAG

GTTAAAAAGGCTGTGAAGAATGACCTGCAAAAATCAATTACAGAAATAAATGAGTTGGTA

AGTAATTACAAACTTTGCAGCGATGATAATATAAAGGCAGAGACGTACATACATGAAATA

TCTCATATCCTCAACAATTTCGAAGCCCAAGAACTGAAGTACAACCCGGAAATTCATCTT

GTAGAGTCTGAGTTGAAGGCCTCCGAATTGAAAAACGTTCTTGACGTAATTATGAATGCC

TTCCACTGGTGCTCAGTATTCATGACGGAAGAGCTCGTGGATAAAGACAACAATTTTTAC

GCTGAACTGGAAGAAATATATGACGAGATTTACCCCGTAATTTCACTCTACAACTTGGTA

CGAAATTACGTTACCCAAAAGCCATACTCAACAAAAAAAATTAAACTGAACTTCGGGATA

CCCACCCTCGCAGATGGATGGTCAAAGTCCAAAGAGTACAGTAACAATGCAATTATCCTG

ATGCGAGACAACCTTTATTACCTCGGGATTTTCAACGCTAAAAATAAACCTGATAAAAAA

ATAATTGAGGGTAATACCTCTGAAAACAAGGGGGATTATAAAAAGATGATATACAATCTG

CTGCCTGGCCCGAACAAAATGATTCCTAAAGTCTTCTTGTCTTCCAAGACTGGAGTCGAA

ACCTACAAGCCAAGTGCTTATATACTCGAAGGGTACAAACAAAATAAGCACATAAAATCC

AGCAAGGATTTTGATATTACATTCTGCCACGATTTGATTGATTATTTTAAGAACTGTATA

GCCATCCACCCAGAATGGAAGAATTTTGGTTTTGATTTTAGCGATACCTCAACATATGAG

GATATCTCTGGCTTTTACCGCGAGGTAGAACTGCAAGGTTATAAGATCGATTGGACTTAT

ATTTCTGAAAAGGACATAGATCTCCTGCAAGAGAAAGGGCAACTTTATTTGTTTCAAATA

TACAACAAAGATTTTAGTAAGAAGAGTACTGGCAATGATAACCTTCACACTATGTATCTG

AAGAACCTTTTTTCTGAGGAGAACTTGAAGGACATAGTCCTTAAACTCAATGGGGAAGCT

GAAATATTCTTTCGCAAAAGCTCCATTAAAAACCCGATCATTCATAAAAAGGGTTCCATC

TTGGTAAACCGCACATACGAGGCGGAAGAAAAAGATCAGTTCGGAAATATCCAGATCGTA

AGGAAGAATATCCCCGAAAATATATACCAAGAGCTTTACAAATATTTTAACGATAAGTCA

GACAAGGAACTGTCAGACGAAGCAGCCAAGTTGAAGAATGTCGTAGGGCACCACGAAGCA

GCTACAAACATAGTTAAAGATTATCGGTACACCTACGATAAATATTTCCTGCATATGCCA

ATAACCATAAACTTCAAAGCCAACAAAACAGGGTTCATCAATGACCGAATACTTCAGTAT

ATAGCCAAGGAAAAAGACCTGCATGTTATAGGAATAGATAGAGGTGAGCGCAACTTGATA

TATGTCAGCGTGATAGACACCTGCGGAAATATCGTCGAGCAAAAAAGTTTCAACATTGTT

AATGGCTACGATTACCAAATTAAATTGAAGCAGCAAGAGGGGGCTCGGCAAATCGCGCGA

AAGGAATGGAAAGAAATCGGGAAGATTAAAGAAATTAAAGAGGGCTACCTGTCTCTTGTA

ATTCACGAAATATCTAAGATGGTCATCAAGTATAATGCCATTATTGCGATGGAAGATCTG

TCCTACGGATTTAAGAAAGGCAGGTTTAAAGTCGAAAGGCAGGTGTACCAGAAATTCGAG

ACCATGCTGATTAATAAGCTCAACTATCTCGTATTTAAGGATATTTCTATAACTGAAAAT

GGAGGGCTTCTCAAAGGATATCAACTCACATACATACCTGATAAGCTGAAGAACGTAGGC

CACCAGTGTGGATGCATATTCTATGTACCAGCTGCATACACAAGCAAGATCGATCCAACT

ACTGGGTTTGTCAATATCTTCAAATTTAAGGACTTGACGGTCGATGCCAAACGGGAGTTC

ATCAAAAAGTTTGATAGTATTCGATATGATAGTGAGAAGAACTTGTTTTGCTTCACATTT

GACTACAACAATTTCATAACGCAAAATACGGTTATGTCTAAATCCTCATGGAGCGTCTAC

ACTTACGGAGTGAGGATAAAGCGGCGCTTCGTAAATGGCAGGTTTAGCAATGAATCCGAC

ACGATTGACATAACCAAGGATATGGAGAAAACCCTCGAGATGACCGATATAAATTGGCGG

-continued

GATGGACACGATCTGCGACAAGACATAATCGATTATGAAATCGTGCAGCACATATTTGAG

ATATTCAGGCTTACGGTCCAAATGAGAAATTCCCTTTCCGAACTTGAAGACCGCGATTAC

GACCGACTGATAAGCCCCGTTCTGAACGAAAATAACATCTTCTACGACAGCGCTAAAGCG

GGAGACGCGCTGCCGAAAGATGCGGACGCAAATGGAGCCTATTGTATCGCCTTGAAAGGG

TTGTACGAGATCAAACAGATAACCGAGAATTGGAAGGAGGATGGGAAGTTTAGTCGAGAC

AAACTTAAAATAAGCAACAAGGACTGGTTCGACTTTATTCAAAACAAACGATATCTCAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 62
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAATAATGGT

ACTAACAATTTTCAAAACTTTATCGGCATCTCTTCACTTCAGAAAACTCTTCGGAACGCC

CTTATACCGACGGAGACAACGCAGCAGTTTATAGTTAAAAACGGGATCATTAAAGAAGAT

GAACTCAGAGGGGAAAACAGGCAAATATTGAAGGACATTATGGACGATTACTACCGGGGG

TTTATTTCAGAGACCCTTTCATCTATTGATGACATAGATTGGACCTCCCTTTTCGAGAAA

ATGGAGATACAATTGAAAAACGGCGACAATAAAGATACACTTATCAAGGAACAAACTGAG

TATCGCAAGGCGATTCACAAGAAGTTTGCGAATGACGATCGCTTTAAGAATATGTTTTCT

GCGAAGCTCATAAGTGACATTCTGCCTGAATTTGTCATTCATAACAACAATTATTCTGCT

AGCGAAAAAGAGGAAAAAACTCAAGTCATTAAGCTTTTTAGCAGGTTCGCTACTAGTTTT

AAAGACTATTTTAAGAACCGGGCGAATTGCTTTAGCGCTGACGACATATCATCCTCATCC

TGTCATCGCATAGTCAATGATAATGCAGAAATATTCTTTTCTAATGCGCTCGTGTATCGG

AGAATAGTGAAAAGCCTCTCTAACGATGACATTAACAAAATAAGCGGCGATATGAAGGAT

AGTCTGAAGGAAATGTCCCTCGAAGAAATATACTCATACGAGAAGTACGGAGAATTTATC

ACCCAGGAAGGAATTAGTTTTTACAACGACATCTGTGGTAAGGTTAACTCTTTTATGAAT

CTGTATTGTCAAAAGAATAAAGAAAATAAAAATCTTTATAAGCTCCAAAAGCTTCACAAA

CAAATCTTGTGCATTGCGGATACGTCATACGAAGTACCTTACAAATTTGAAAGCGACGAA

GAGGTGTATCAGTCAGTGAATGGGTTCCTTGACAATATTTCTAGCAAACATATTGTGGAG

CGACTTCGAAAGATCGGTGATAATTACAATGGCTATAATTTGGATAAAATTTACATAGTT

AGTAAGTTTTATGAATCCGTCTCACAAAAGACGTACCGAGATTGGGAGACCATCAACACT

GCTCTGGAGATTCATTACAATAATATATTGCCTGGGAATGGGAAGTCAAAGGCCGACAAG

GTTAAAAAAGCCGTAAAAAACGATCTTCAAAAGTCCATTACCGAGATAAATGAACTTGTA

TCCAACTATAAGTTGTGCTCTGACGATAATATTAAAGCAGAAACGTATATCCACGAAATA

AGTCACATCCTGAACAACTTCGAAGCTCAAGAGCTCAAGTATAATCCTGAAATTCATCTC

GTCGAAAGCGAGCTGAAAGCATCCGAGTTGAAGAATGTGCTTGATGTGATCATGAACGCA

TTCCATTGGTGCAGTGTGTTCATGACCGAAGAACTTGTAGACAAAGACAACAACTTCTAC

GCTGAATTGGAAGAGATTTACGATGAAATTTACCCCGTGATATCCCTCTATAATCTGGTA

AGAAATTACGTCACGCAAAAACCATACAGTACCAAGAAAATAAAGCTCAACTTTGGTATT

CCGACGTTGGCAGATGGGTGGAGTAAGAGCAAGGAGTATTCTAACAATGCAATCATCCTC

ATGCGCGACAATTTGTATTATCTGGGGATCTTCAACGCGAAAAATAAGCCCGACAAAAAG

ATAATAGAAGGCAATACGTCCGAGAACAAAGGGGACTATAAGAAAATGATTTATAACCTT

-continued

CTTCCAGGACCCAACAAGATGATCCCAAAGGTTTTCTTGAGTTCAAAAACCGGCGTAGAA

ACTTATAAACCGTCCGCCTACATTCTGGAAGGGTACAAGCAAAACAAGCACATTAAGTCA

TCTAAGGATTTCGACATTACTTTTTGTCATGATTTGATAGACTACTTCAAAAATTGTATA

GCGATACATCCGGAATGGAAAAATTTTGGGTTCGATTTTTCCGACACAAGTACTTATGAA

GACATCTCAGGGTTTTATAGGGAAGTTGAACTGCAAGGTTACAAAATAGACTGGACTTAT

ATTAGTGAGAAGGACATTGATTTGCTCCAGGAAAAGGGTCAATTGTATCTGTTCCAGATA

TATAACAAGGATTTCTCTAAAAAATCTACAGGTAACGACAATCTCCACACGATGTACCTC

AAGAATCTCTTCAGCGAAGAGAATTTGAAGGATATCGTACTTAAGCTCAATGGAGAAGCG

GAAATATTCTTCAGAAAGTCCAGCATTAAGAATCCTATAATTCACAAGAAAGGGTCAATT

CTCGTAAACCGGACTTATGAGGCCGAAGAAAAAGATCAGTTTGGTAACATTCAGATTGTA

CGGAAAAACATTCCCGAGAACATCTATCAAGAACTGTATAAATACTTTAATGATAAATCC

GACAAGGAACTTTCTGACGAGGCTGCAAAATTGAAGAACGTAGTGGGACACCATGAGGCC

GCAACCAATATAGTAAAGGATTACAGATACACTTATGATAAGTATTTCCTCCATATGCCG

ATCACGATTAATTTCAAGGCGAATAAAACCGGCTTCATTAACGATCGCATTTTGCAATAT

ATTGCGAAGGAAAAGGATTTGCACGTGATAGGTATAGACCGGGGTGAACGAAACTTGATT

TACGTCTCTGTGATCGACACATGCGGAAATATAGTTGAACAGAAGTCCTTTAATATTGTG

AATGGTTACGACTACCAGATAAAATTGAAGCAACAGGAGGGCGCAAGACAGATAGCTCGC

AAAGAGTGGAAGGAAATCGGCAAGATCAAAGAAATAAAGGAGGGTTATCTTTCCCTGGTA

ATTCATGAAATTAGCAAGATGGTTATTAAGTATAATGCTATAATAGCTATGGAGGACCTT

TCCTATGGGTTCAAGAAAGGTCGCTTCAAAGTGGAGCGACAAGTGTATCAAAAGTTCGAG

ACTATGTTGATAAATAAATTGAATTATTTGGTTTTTAAAGACATTTCAATAACTGAGAAC

GGGGGTCTCTTGAAGGGGTACCAATTGACTTATATTCCGGACAAGTTGAAGAATGTCGGA

CACCAGTGTGGTTGCATTTTCTACGTGCCTGCCGCTTACACCTCAAAAATCGATCCGACC

ACTGGTTTTGTAAATATATTTAAATTCAAAGATCTCACCGTTGATGCCAAACGGGAGTTT

ATCAAAAAATTCGATTCCATTCGCTACGACTCTGAGAAAAACCTTTTTTGTTTCACGTTC

GATTATAACAACTTTATAACCCAAAATACTGTAATGTCCAAGTCAAGTTGGTCTGTCTAT

ACTTACGGAGTAAGGATCAAGCGCCGCTTCGTTAATGGGAGATTCTCAAACGAGTCTGAT

ACCATAGACATAACTAAAGACATGGAAAAAACCCTGGAAATGACGGACATCAATTGGCGA

GACGGGCATGATCTTCGACAGGACATAATAGATTACGAAATTGTTCAACACATTTTCGAG

ATATTTCGACTTACGGTTCAGATGAGGAATTCCCTTTCCGAATTGGAAGACCGGGATTAT

GATCGACTTATATCTCCCGTGCTCAATGAAAACAATATTTTTTATGATTCAGCGAAAGCT

GGGGACGCGCTGCCAAAAGATGCCGATGCCAATGGAGCATACTGTATCGCCCTGAAGGGT

TTGTATGAGATTAAGCAAATTACTGAAAACTGGAAGGAAGATGGCAAGTTTTCTAGAGAT

AAGCTTAAGATTAGCAATAAGGACTGGTTTGACTTCATTCAAAATAAAAGGTATCTTAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 63
ATGGGCCATCATCATCATCATCACAGCAGCGGCGTCGATCTGGGTACCGAGAATTTGTAT

TTCCAGAGCCCAGCGGCTAAAAAAAAGAAACTGGATGGCAGCGTGGATATGAATAATGGA

ACAAATAATTTTCAAAATTTTATTGGTATCAGTTCATTGCAAAAGACTTTGAGAAATGCT

-continued

TTGATCCCGACTGAGACCACACAGCAGTTCATCGTCAAAAATGGCATAATCAAGGAAGAC

GAACTTAGGGGTGAGAATAGACAAATATTGAAGGACATCATGGATGACTATTATAGGGGG

TTCATTTCCGAAACGCTCAGTAGTATTGATGACATTGACTGGACTAGTCTTTTCGAGAAA

ATGGAAATTCAGCTTAAGAACGGGGACAATAAAGACACGCTGATCAAGGAGCAAACGGAA

TATAGGAAGGCGATCCATAAAAAATTCGCGAATGATGATCGGTTTAAAAACATGTTTAGT

GCCAAGTTGATCAGCGACATACTGCCCGAATTCGTGATCCACAACAATAATTACAGCGCC

TCCGAAAAGGAGGAAAAAACTCAGGTCATTAAATTGTTTAGCCGATTCGCAACGAGTTTC

AAAGATTATTTTAAGAACCGGGCCAACTGTTTTTCAGCGGATGATATTAGCTCCAGCAGC

TGCCATCGCATAGTAAATGATAACGCTGAAATCTTTTTTAGCAACGCACTTGTCTACCGG

AGGATTGTAAAATCACTGTCAAATGATGACATTAACAAAATATCTGGAGATATGAAGGAC

TCACTCAAAGAAATGAGCCTGGAAGAAATATATTCATACGAAAAATACGGGGAGTTTATT

ACCCAGGAAGGTATCAGTTTTTATAATGATATATGTGGAAAAGTTAATTCATTTATGAAT

CTTTACTGTCAAAAAAATAAGGAGAACAAGAATTTGTACAAGCTCCAAAAACTTCATAAA

CAGATTCTGTGCATCGCAGACACAAGTTATGAGGTACCGTACAAATTTGAGAGCGACGAA

GAAGTTTATCAGAGTGTGAATGGTTTCCTGGACAATATCTCTTCTAAACACATTGTTGAG

AGGCTTAGGAAGATCGGTGATAATTATAACGGCTATAATCTGGACAAAATTTATATTGTA

TCAAAGTTTTATGAATCAGTCTCTCAAAAGACGTATCGGGATTGGGAAACAATTAACACG

GCTCTGGAGATCCACTACAATAACATTCTGCCCGGCAACGGGAAGAGCAAAGCTGATAAG

GTCAAGAAGGCAGTCAAGAACGACCTTCAGAAGAGCATAACAGAAATTAACGAATTGGTC

AGTAACTACAAACTGTGTAGTGATGACAACATAAAAGCCGAAACATACATCCATGAAATA

AGCCATATCCTGAATAACTTCGAAGCCCAAGAACTTAAATACAATCCCGAGATTCATCTT

GTCGAATCAGAACTCAAGGCGTCCGAGCTCAAAAATGTCCTTGACGTGATAATGAATGCC

TTCCACTGGTGCAGCGTATTCATGACGGAGGAGTTGGTAGATAAAGACAACAACTTTTAT

GCCGAATTGGAAGAGATTTATGATGAGATTTACCCCGTTATTTCTCTGTACAACTTGGTT

CGAAACTACGTAACACAAAAACCATACTCAACCAAAAAGATCAAACTCAATTTTGGCATA

CCTACATTGGCTGATGGTTGGTCCAAGTCAAAGGAATATAGCAATAATGCAATAATTCTC

ATGCGAGATAACTTGTATTATTTGGGGATCTTTAACGCTAAGAACAAACCAGATAAAAAG

ATAATCGAGGGGAACACAAGTGAGAACAAGGGTGATTACAAAAAAATGATTTACAATCTG

CTTCCTGGGCCTAACAAAATGATTCCGAAGGTGTTTCTTAGCTCTAAAACTGGAGTGGAG

ACGTATAAGCCTTCCGCGTACATTCTCGAAGGCTACAAGCAAAATAAGCATATCAAGTCC

AGTAAGGACTTCGACATCACTTTTTGCCACGATCTCATCGATTACTTTAAGAACTGTATC

GCAATACACCCCGAGTGGAAAAACTTTGGTTTTGATTTTTCAGACACTAGTACCTACGAG

GACATTTCCGGCTTCTATCGAGAAGTCGAACTCCAGGGCTACAAAATCGATTGGACGTAC

ATTTCTGAGAAGGACATCGACTTGCTCCAAGAGAAAGGTCAACTTTACCTCTTCCAAATT

TACAATAAAGACTTTTCAAAGAAGAGCACCGGTAATGACAACTTGCATACCATGTATCTG

AAGAACCTGTTTTCTGAGGAGAACCTCAAGGATATTGTATTGAAGTTGAATGGCGAAGCA

GAAATATTTTTCCGAAAGTCATCTATCAAGAACCCCATTATACACAAAAAAGGCTCTATC

CTGGTGAACCGGACTTACGAGGCAGAGGAGAAGGATCAATTCGGAAACATACAGATAGTC

CGCAAAAACATCCCTGAGAATATCTATCAGGAACTCTATAAGTACTTCAATGATAAATCA

GACAAGGAGCTTAGCGACGAAGCAGCTAAACTTAAAAACGTGGTTGGCCATCACGAGGCC

GCTACCAACATAGTCAAAGACTACCGCTATACTTATGACAAGTACTTTTTGCACATGCCC

-continued

ATAACAATTAATTTCAAAGCTAACAAAACAGGGTTTATAAATGACAGAATCCTCCAATAC

ATCGCCAAAGAGAAGGACCTCCATGTAATCGGGATTGATAGAGGCGAACGGAACTTGATT

TACGTTAGTGTCATTGATACCTGTGGTAACATTGTCGAACAAAAGTCATTCAACATAGTC

AATGGATATGATTATCAGATAAAACTCAAGCAACAAGAAGGCGCGAGGCAGATTGCCAGG

AAGGAATGGAAAGAAATCGGGAAGATCAAGGAGATCAAGGAGGGTTACCTGTCCTTGGTG

ATACACGAGATTTCAAAAATGGTTATAAAATACAATGCCATTATCGCGATGGAGGATTTG

TCTTATGGATTTAAGAAGGGGAGGTTCAAAGTCGAACGACAAGTCTATCAGAAGTTTGAA

ACAATGCTCATTAACAAGCTCAATTACCTTGTTTTCAAGGATATAAGCATCACTGAAAAC

GGCGGACTCCTTAAGGGATATCAGCTGACTTATATCCCCGACAAGCTCAAGAACGTAGGG

CACCAATGCGGATGCATCTTTTACGTGCCTGCAGCATATACTTCAAAAATTGATCCGACT

ACTGGCTTTGTTAACATTTTCAAGTTCAAGGATCTGACGGTAGACGCTAAGAGAGAATTC

ATAAAAAAGTTTGACAGCATCAGGTACGATAGTGAAAAGAACCTTTTTTGTTTTACCTTT

GACTACAATAATTTTATTACGCAAAATACAGTTATGAGCAAATCAAGTTGGAGCGTTTAC

ACATATGGCGTTCGGATCAAGCGCAGATTCGTCAATGGTCGCTTCTCAAATGAGAGCGAT

ACAATCGATATAACGAAGGATATGGAGAAGACGCTTGAGATGACAGATATCAACTGGCGG

GACGGACATGACCTTAGACAAGACATAATCGATTACGAAATAGTACAGCATATCTTTGAG

ATTTTTAGGCTTACAGTTCAGATGCGGAACTCTCTTTCCGAACTGGAGGACCGGGATTAT

GATCGGTTGATCTCCCCAGTACTGAACGAAAATAATATCTTTTACGATAGCGCGAAGGCT

GGTGATGCACTCCCAAAAGACGCTGATGCGAACGGAGCTTATTGCATAGCCCTTAAAGGG

CTTTACGAGATTAAACAAATAACAGAAAATTGGAAGGAAGATGGCAAATTTTCCCGCGAC

AAGTTGAAGATTAGTAACAAAGACTGGTTCGACTTCATTCAGAATAAACGCTACCTCAAA

CGTCCGGCAGCGACCAAAAAAGCCGGCCAGGCGAAGAAAAAAAAAGCGTCAGGTAGCGGC

GCAGGCAGCCCGAAAAAGAAACGTAAAGTCGAGGATCCGAAAAAGAAACGTAAGGTTATT

CCGGGCTAA

SEQ ID NO: 64
AGCCCAGCGGCTAAAAAAAAGAAACTGGATGGCAGCGTGGATATGAATAACGGTACCAAT

AACTTCCAGAACTTCATCGGTATTTCTAGCCTGCAAAAGACCCTGCGTAACGCGCTGATT

CCGACCGAGACTACCCAGCAATTCATCGTGAAAAACGGTATCATTAAGGAAGATGAATTG

CGCGGTGAGAATCGTCAGATTCTGAAAGATATCATGGATGACTACTATCGCGGTTTCATT

AGCGAAACCCTGTCGAGCATCGATGATATCGATTGGACGAGCCTCTTCGAGAAAATGGAA

ATTCAACTGAAAAATGGTGACAACAAAGATACCCTGATTAAAGAACAAACGGAATACCGC

AAGGCAATCCATAAAAAGTTTGCGAATGACGACCGTTTTAAGAATATGTTCTCGGCCAAG

CTGATTTCCGACATCCTGCCAGAGTTCGTCATTCACAACAACAATTACAGCGCAAGCGAG

AAAGAGGAAAAGACTCAGGTCATTAAGCTGTTTAGCCGCTTTGCGACGTCCTTCAAAGAC

TACTTCAAGAATCGTGCGAATTGCTTTAGCGCGGATGACATCTCTAGCTCTAGCTGTCAC

CGTATTGTTAACGACAATGCAGAGATTTTCTTCAGCAACGCCCTGGTGTATCGCCGTATT

GTCAAGTCTCTGAGCAACGACGACATTAACAAGATCAGCGGCGACATGAAAGACAGCCTG

AAAGAAATGTCTCTGGAAGAAATCTACAGCTACGAGAAATATGGTGAGTTTATCACCCAA

GAGGGCATTAGCTTCTACAATGATATCTGTGGTAAGGTTAATAGCTTTATGAATCTGTAC

TGCCAGAAGAATAAAGAAAACAAGAACTTGTACAAGCTGCAAAAGCTGCATAAGCAAATT

CTGTGCATCGCCGATACTAGCTATGAAGTTCCGTACAAGTTCGAGTCTGATGAAGAGGTG

-continued

TATCAGTCAGTCAACGGTTTTCTGGATAACATCAGCAGCAAGCACATCGTCGAGCGCCTG
CGCAAGATTGGTGACAACTACAATGGTTATAACCTGGACAAGATCTATATCGTGTCGAAG
TTTTACGAGAGCGTGTCCCAGAAAACGTACCGTGATTGGGAAACGATTAACACGGCCTTG
GAAATTCACTATAACAATATCCTGCCGGGCAACGGCAAGAGCAAAGCTGACAAAGTCAAA
AAAGCTGTGAAAAACGATCTGCAAAAGTCCATCACCGAGATCAACGAACTGGTTAGCAAC
TATAAGCTGTGTAGCGACGACAACATTAAAGCTGAAACGTATATCCACGAAATCAGCCAC
ATCCTGAATAACTTTGAGGCACAAGAACTGAAATACAATCCTGAGATCCATCTGGTAGAG
AGCGAGCTGAAGGCAAGCGAGTTGAAAAACGTTCTCGACGTTATCATGAATGCTTTCCAC
TGGTGTAGCGTGTTTATGACCGAAGAACTGGTTGACAAAGATAACAATTTCTATGCAGAG
CTGGAAGAAATCTATGATGAAATCTACCCGGTCATCAGCCTGTATAACCTGGTTCGTAAC
TACGTGACGCAGAAGCCGTACAGCACCAAAAAGATCAAGCTGAACTTCGGTATTCCGACC
TTGGCGGACGGTTGGAGCAAATCCAAAGAATACTCCAATAATGCGATTATTCTGATGCGT
GATAATCTGTACTATCTGGGTATCTTCAATGCGAAGAACAAGCCAGATAAAAAGATTATT
GAAGGCAACACCAGCGAGAATAAAGGCGACTACAAGAAAATGATCTACAACTTATTGCCG
GGTCCGAACAAGATGATCCCGAAAGTTTTTCTGAGCAGCAAGACCGGCGTTGAAACCTAT
AAGCCGAGCGCGTACATTTTAGAGGGCTATAAACAAAACAAGCACATCAAGAGCAGCAAA
GATTTTGATATTACGTTCTGCCACGACCTGATCGACTATTTCAAGAATTGTATTGCGATT
CACCCTGAGTGGAAGAACTTCGGTTTTGACTTTTCCGATACCTCCACCTATGAAGATATT
AGCGGTTTTTACCGTGAAGTCGAGTTGCAGGGTTATAAGATTGATTGGACTTACATTTCC
GAGAAAGACATCGACCTGTTGCAAGAGAAAGGTCAGCTGTACCTGTTTCAGATCTATAAC
AAAGATTTCAGCAAAAAGTCGACGGGCAATGATAATCTGCACACCATGTATCTGAAAAAC
CTGTTTAGCGAAGAGAACCTGAAAGACATTGTTCTTAAGCTGAATGGTGAGGCCGAGATC
TTCTTCCGTAAAAGCTCCATTAAGAACCCGATTATCCACAAAAAGGGCTCTATTCTGGTT
AACCGCACGTACGAAGCGGAAGAGAAAGATCAATTTGGTAACATCCAGATCGTGCGTAAG
AATATCCCGGAGAACATTTACCAAGAACTGTATAAGTATTTCAATGACAAGAGCGATAAA
GAATTGAGCGATGAAGCGGCAAAGCTGAAAAACGTCGTTGGCCACCACGAAGCCGCGACG
AATATCGTGAAAGATTATCGTTACACCTACGACAAGTACTTTCTGCACATGCCGATCACC
ATCAATTTCAAAGCGAATAAAACGGGTTTTATCAATGACCGTATCCTGCAGTACATTGCG
AAAGAAAAAGATTTACACGTGATTGGTATTGATCGCGGCGAGCGCAATCTGATTTACGTC
AGCGTTATCGACACGTGCGGCAATATTGTGGAGCAGAAAAGCTTCAATATCGTCAATGGT
TACGACTACCAGATCAAACTGAAGCAACAAGAGGGCGCCCGCCAGATTGCGCGTAAAGAG
TGGAAAGAAATCGGTAAGATTAAAGAAATCAAGGAAGGCTACCTGTCCCTGGTGATCCAT
GAAATCAGCAAAATGGTGATCAAGTACAACGCTATCATTGCGATGGAAGATCTGAGCTAC
GGTTTTAAAAAGGGTCGCTTCAAAGTTGAGCGTCAAGTGTATCAGAAATTTGAGACTATG
CTGATTAACAAGTTGAACTATCTGGTTTTTAAAGACATCAGCATTACCGAGAATGGTGGC
CTGCTGAAGGGTTATCAACTGACCTATATTCCTGACAAGTTGAAAAATGTTGGTCATCAG
TGTGGTTGCATTTTCTACGTACCGGCAGCGTACACGAGCAAGATTGACCCGACCACGGGT
TTCGTTAACATTTTCAAGTTTAAAGATTTGACCGTGGACGCCAAGCGTGAGTTCATTAAA
AAGTTCGACAGCATCAGATACGACTCTGAGAAGAATCTGTTCTGCTTTACGTTCGACTAC
AATAACTTCATTACCCAAAATACCGTTATGAGCAAAAGCTCCTGGAGCGTGTACACGTAC

-continued

GGCGTCCGTATCAAGCGTCGTTTTGTGAATGGTCGCTTTTCCAACGAATCTGACACCATT

GACATTACCAAAGATATGGAAAAGACCCTTGAGATGACCGACATTAATTGGCGTGATGGC

CATGACTTGCGCCAAGACATTATCGACTACGAAATTGTTCAGCACATCTTTGAGATTTTT

CGTCTGACGGTCCAGATGCGCAACTCGCTGAGCGAGTTGGAAGATCGTGACTATGACCGT

CTGATTAGCCCGGTGCTGAATGAAAACAATATCTTCTATGATAGCGCAAAGGCCGGTGAC

GCGCTGCCGAAAGATGCGGATGCTAACGGTGCATACTGCATTGCACTGAAGGGTCTGTAC

GAAATCAAACAGATCACCGAGAATTGGAAAGAGGATGGTAAGTTTAGCCGTGATAAGCTG

AAGATTAGCAATAAAGACTGGTTCGACTTTATTCAAAACAAGCGCTATCTGAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 65
AGCCCAGCGGCTAAAAAAAAGAAACTGGATGGCAGCGTGGATATGAACAACGGAACAAAT

AATTTTCAGAACTTTATTGGGATCAGTTCGCTTCAGAAAACGCTTCGTAATGCTCTGATT

CCCACAGAAACCACTCAGCAGTTTATCGTAAAGAATGGCATTATCAAGGAGGATGAATTA

CGCGGCGAGAACCGCCAAATCTTAAAAGATATCATGGACGACTACTACCGCGGTTTCATT

AGCGAAACTCTTAGTTCAATTGACGACATTGACTGGACGTCCTTGTTCGAAAAGATGGAG

ATTCAATTAAAGAACGGTGATAACAAGGATACGTTGATTAAAGAACAGACGGAGTACCGT

AAGGCTATCCACAAAAAATTTGCAAACGACGACCGCTTTAAAAATATGTTTAGCGCAAAA

TTAATCTCCGACATCCTGCCTGAATTCGTCATCCATAACAATAACTATAGCGCCTCGGAA

AAAGAAGAAAAAACGCAGGTTATTAAACTTTTCTCGCGCTTTGCAACAAGCTTTAAGGAT

TACTTCAAAAATCGCGCCAATTGTTTTTCAGCCGACGACATTAGCTCCAGTTCCTGCCAC

CGTATTGTGAATGACAACGCTGAGATTTTTTTTCCAATGCGCTGGTTTATCGTCGTATT

GTTAAGAGCCTTAGTAACGACGACATTAATAAAATTAGCGGTGATATGAAGGATAGCTTG

AAAGAAATGAGTCTGGAAGAGATCTATAGTTACGAGAAGTACGGCGAATTTATTACCCAG

GAGGGCATTTCATTTTACAATGATATCTGTGGAAAAGTCAACTCCTTTATGAACTTGTAT

TGCCAAAAGAATAAAGAAAACAAAAACCTGTACAAACTGCAAAAGTTACACAAGCAGATT

TTGTGTATCGCAGACACGTCATACGAAGTACCGTACAAGTTTGAGTCCGATGAAGAAGTG

TACCAAAGCGTTAATGGCTTTTTGGATAACATTTCGAGCAAACATATCGTAGAGCGTTTG

CGTAAGATTGGTGATAATTACAACGGTTACAATTTAGACAAAATCTATATCGTCTCTAAG

TTTTACGAAAGTGTTTCTCAGAAAACTTACCGCGATTGGGAGACGATCAACACTGCGCTG

GAGATTCATTACAATAATATCCTTCCAGGTAACGGTAAAAGCAAAGCTGATAAGGTGAAA

AAGGCGGTTAAAAATGACCTTCAAAAGTCTATCACAGAAATCAACGAATTGGTCAGCAAT

TATAAGCTTTGCAGTGACGATAACATTAAGGCCGAGACTTACATCCATGAGATCTCTCAC

ATTCTTAATAATTTTGAAGCGCAAGAGCTGAAATACAATCCTGAAATCCATCTGGTCGAA

AGTGAATTAAAAGCCTCCGAATTAAAAAATGTCTTGGACGTGATCATGAATGCGTTCCAT

TGGTGCTCAGTTTTTATGACGGAAGAGTTGGTGGACAAAGACAACAATTTTTACGCCGAG

CTTGAGGAAATTTACGACGAAATTTACCCCGTTATTTCGTTATACAACCTTGTGCGTAAT

TACGTTACACAAAAGCCCTATTCGACAAAGAAAATCAAGTTAAATTTCGGGATTCCCACA

TTAGCTGATGGATGGTCCAAATCCAAAGAATACTCGAATAACGCTATCATCCTTATGCGT

GATAATTTGTACTACTTAGGCATCTTCAATGCGAAGAACAAACCTGACAAGAAAATTATC

-continued

GAAGGAAACACTTCGGAGAACAAAGGTGATTATAAAAAGATGATCTACAACTTGCTTCCC

GGGCCAAACAAAATGATTCCCAAGGTATTTTTGAGTTCTAAAACCGGTGTCGAAACTTAC

AAACCAAGTGCTTATATTTTGGAAGGATACAAACAGAACAAACATATCAAGTCTTCGAAA

GACTTCGATATTACGTTCTGCCACGATCTGATCGATTACTTCAAGAACTGTATTGCTATT

CACCCCGAGTGGAAGAACTTTGGATTTGATTTCTCCGACACGTCCACTTATGAAGATATC

TCTGGCTTCTATCGCGAGGTTGAATTACAAGGGTATAAGATTGACTGGACTTATATTTCG

GAGAAGGATATCGATCTTTTGCAAGAAAAAGGGCAACTTTATTTATTTCAGATCTATAAC

AAGGACTTTTCAAAAAAGAGCACTGGAAATGACAATCTGCATACCATGTACCTTAAGAAC

CTGTTCTCGGAAGAGAACCTGAAGGACATTGTACTTAAACTGAATGGAGAGGCAGAGATC

TTCTTTCGCAAATCAAGCATTAAGAACCCAATTATTCACAAAAAGGGGAGTATCTTAGTA

AATCGCACATATGAGGCTGAGGAAAAAGATCAGTTTGGTAACATTCAGATCGTGCGTAAG

AACATTCCTGAAAATATCTATCAGGAACTTTATAAGTATTTCAACGATAAAAGTGATAAA

GAGCTGAGTGACGAAGCGGCTAAACTTAAGAATGTTGTGGGACACCATGAGGCAGCAACC

AATATTGTGAAGGATTATCGCTATACGTACGACAAATACTTTTTACACATGCCCATCACT

ATTAATTTTAAAGCTAATAAGACTGGCTTCATTAACGATCGCATCCTGCAGTACATTGCT

AAGGAAAAGGATCTTCACGTTATCGGTATCGATCGCGGGGAGCGTAATCTTATCTACGTC

TCTGTCATTGACACGTGTGGCAATATTGTGGAGCAAAAGTCCTTCAATATTGTTAACGGC

TATGACTATCAGATTAAATTGAAACAGCAGGAAGGTGCGCGTCAGATTGCCCGCAAGGAA

TGGAAGGAAATTGGCAAGATCAAAGAAATTAAGGAGGGCTACTTAAGCTTAGTAATTCAC

GAAATTAGTAAAATGGTTATCAAATACAACGCCATCATCGCGATGGAGGATCTTTCGTAC

GGGTTTAAGAAAGGTCGTTTTAAAGTGGAGCGTCAGGTGTACCAGAAATTTGAAACTATG

CTTATTAACAAACTTAACTACCTGGTTTTCAAGGATATCAGTATTACTGAAAACGGGGGG

CTGTTAAAAGGGTATCAATTAACTTACATTCCAGACAAATTAAAGAACGTTGGACATCAG

TGTGGCTGCATTTTTTATGTACCAGCTGCATACACTTCAAAGATCGATCCTACGACTGGG

TTCGTGAACATTTTTAAGTTTAAAGACTTGACGGTAGATGCCAAGCGCGAATTCATCAAG

AAATTCGACAGCATTCGCTACGACTCTGAGAAAAATCTTTTCTGTTTCACATTCGATTAT

AACAATTTCATTACGCAGAACACAGTAATGTCCAAGTCTTCTTGGAGTGTTTATACATAT

GGTGTCCGCATTAAGCGCCGTTTCGTCAACGGCCGCTTCAGTAATGAGAGCGATACTATT

GACATCACAAAAGACATGGAAAAAACACTGGAAATGACCGACATCAATTGGCGTGACGGC

CATGACTTACGTCAGGATATCATTGATTATGAGATCGTTCAACACATCTTCGAAATCTTT

CGCTTGACTGTTCAAATGCGCAATTCCTTGTCGGAATTGGAGGACCGTGATTATGACCGC

TTAATTTCCCCCGTCTTAAATGAAAACAATATTTTTTATGACTCTGCAAAAGCTGGAGAT

GCTCTGCCGAAAGACGCCGATGCAAATGGGGCATATTGCATTGCTTTAAAGGGGCTTTAC

GAGATCAAGCAAATCACCGAAAACTGGAAAGAGGATGGAAAGTTTTCGCGTGATAAACTG

AAGATCTCTAACAAAGACTGGTTCGACTTTATCCAGAACAAGCGTTATTTGAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 66
AGCCCAGCGGCTAAAAAAAAGAAACTGGATGGCAGCGTGGATATGAACAACGGCACCAAT

AACTTCCAAAACTTCATCGGGATCTCTAGCCTTCAGAAGACGCTTCGCAATGCTCTTATC

-continued

CCAACTGAGACCACTCAACAATTTATTGTGAAGAATGGAATTATTAAAGAGGACGAACTG

CGTGGCGAGAATCGTCAGATCTTAAAGGACATTATGGATGATTATTACCGTGGATTCATC

TCCGAAACATTATCGTCGATCGATGATATCGATTGGACTTCTCTGTTCGAGAAAATGGAA

ATTCAATTGAAAAACGGAGATAATAAAGATACGCTTATCAAAGAACAGACGGAATATCGT

AAAGCGATTCATAAGAAATTCGCAAATGACGATCGTTTCAAAAAATATGTTCAGTGCCAAG

CTTATTTCGGACATTTTACCTGAATTTGTAATTCATAATAATAACTACTCAGCAAGTGAG

AAGGAGGAGAAAACCCAAGTTATTAAACTGTTCTCTCGTTTCGCAACGTCCTTTAAAGAT

TACTTTAAAAACCGCGCGAATTGCTTTAGCGCTGACGACATTTCCAGCTCATCCTGTCAT

CGCATCGTAAACGACAATGCGGAAATCTTCTTCAGCAACGCCCTGGTTTACCGCCGCATC

GTCAAAAGCTTATCGAATGACGACATCAATAAGATCTCAGGAGATATGAAGGACTCGCTT

AAGGAGATGTCTCTGGAGGAAATTTATAGTTACGAAAAGTATGGAGAGTTCATTACCCAG

GAGGGAATCTCGTTCTACAATGACATTTGCGGGAAGGTGAACTCCTTCATGAACTTATAC

TGCCAGAAAAACAAAGAGAACAAAAATCTGTATAAATTGCAGAAATTACATAAACAGATT

CTTTGTATTGCTGACACTTCCTACGAAGTACCCTATAAATTCGAGTCAGATGAAGAAGTA

TACCAGTCCGTGAACGGATTTCTGGACAATATCTCCTCAAAACACATCGTGGAACGCTTA

CGTAAAATTGGCGATAATTATAATGGTTACAATCTTGACAAAATTTATATCGTATCTAAA

TTTTACGAGAGTGTGAGCCAAAAGACCTACCGCGACTGGGAGACCATCAACACAGCTTTA

GAAATTCACTATAATAATATCTTACCCGGCAATGGTAAGAGCAAGGCTGACAAGGTAAAA

AAGGCCGTCAAGAATGATTTGCAGAAATCTATTACAGAAATTAATGAGTTAGTCTCCAAC

TATAAGCTTTGTTCCGACGATAACATCAAAGCTGAGACATATATTCATGAGATTAGTCAC

ATTCTTAACAACTTCGAGGCCCAGGAACTTAAGTACAATCCTGAAATTCATCTTGTCGAG

TCTGAGCTGAAAGCTAGTGAATTGAAAAATGTTTTAGACGTTATTATGAACGCATTCCAC

TGGTGCTCTGTGTTTATGACAGAAGAACTGGTCGACAAGGACAATAACTTCTATGCCGAA

CTTGAGGAAATCTACGATGAAATTTACCCTGTAATCTCCTTGTATAATCTTGTACGTAAT

TACGTCACTCAAAAACCTTACAGCACGAAAAAAATTAAATTGAACTTCGGGATTCCTACA

CTTGCCGACGGGTGGTCTAAATCCAAGGAATATAGCAACAATGCCATTATTTTAATGCGC

GACAATCTTTACTATTTAGGAATTTTTAACGCTAAGAACAAGCCCGATAAAAAGATTATT

GAAGGAAACACGTCTGAAAATAAGGGCGACTACAAAAAGATGATTTATAACCTTTTGCCC

GGTCCAAACAAAATGATCCCAAAGGTATTCCTGTCATCCAAAACAGGGGTTGAGACATAT

AAGCCCAGCGCATATATTCTGGAAGGATACAAACAGAATAAACATATCAAAAGCAGCAAA

GATTTTGACATTACTTTTTGCCACGATTTAATCGACTACTTCAAAAACTGTATCGCTATC

CACCCTGAATGGAAGAATTTCGGATTTGATTTCTCAGATACAAGTACGTATGAGGATATC

AGCGGTTTCTATCGCGAAGTTGAACTTCAAGGGTATAAAATTGACTGGACCTACATTAGT

GAGAAGGACATCGACCTGTTACAGGAAAAAGGCCAATTGTACTTGTTTCAGATCTACAAT

AAGGATTTCTCAAAAAAATCGACCGGCAATGATAACTTGCACACCATGTACCTGAAGAAC

CTTTTTTCGGAGGAAAACCTTAAAGACATTGTCCTGAAGTTGAATGGAGAAGCGGAGATT

TTCTTTCGTAAGTCTTCCATTAAAAATCCAATTATTCATAAGAAGGGCAGCATCCTTGTG

AACCGTACGTACGAGGCGGAAGAGAAGGACCAATTCGGTAACATTCAAATCGTCCGCAAG

AACATCCCTGAAAATATTTATCAGGAGCTTTACAAGTATTTCAATGATAAGTCCGACAAG

GAATTATCAGATGAGGCTGCGAAGTTGAAAAATGTTGTTGGTCATCACGAGGCGGCGACG

AATATTGTAAAGGATTATCGCTACACTTATGACAAGTACTTTCTGCACATGCCGATCACC

-continued

ATTAATTTCAAGGCGAACAAAACAGGATTTATTAATGACCGCATCTTACAATACATTGCC

AAAGAAAAGGACTTACACGTTATTGGCATTGATCGTGGAGAACGCAACTTAATCTACGTA

AGCGTTATTGACACTTGCGGGAATATCGTAGAACAAAAGAGCTTCAACATCGTGAATGGT

TACGATTACCAGATCAAGCTTAAGCAGCAGGAGGGAGCGCGCCAGATCGCGCGCAAGGAA

TGGAAGGAGATTGGTAAGATCAAGGAAATCAAGGAAGGTTATCTGTCCTTGGTAATCCAC

GAAATTTCGAAAATGGTTATCAAATACAATGCTATTATTGCAATGGAGGACTTGTCCTAC

GGCTTTAAAAAAGGACGCTTTAAGGTGGAGCGCCAGGTTTATCAAAAGTTTGAAACAATG

CTGATTAACAAGCTGAACTATTTGGTCTTTAAAGATATCTCCATCACCGAAAATGGTGGG

CTTTTGAAAGGCTATCAACTTACATATATCCCTGATAAGCTTAAGAATGTGGGTCATCAG

TGCGGGTGCATTTTTTATGTTCCTGCAGCCTACACGTCCAAAATCGATCCTACAACTGGA

TTTGTTAATATCTTCAAATTTAAGGATCTTACCGTCGACGCGAAGCGCGAATTTATCAAG

AAATTCGATAGTATTCGTTATGATTCCGAAAAAAACCTTTTCTGTTTCACCTTTGATTAT

AATAACTTTATCACGCAAAATACTGTCATGAGCAAATCGAGTTGGTCTGTGTACACTTAC

GGAGTACGCATCAAGCGTCGTTTTGTTAATGGGCGCTTCAGTAACGAGTCAGACACGATT

GATATCACAAAAGATATGGAGAAAACGCTGGAGATGACAGACATCAATTGGCGCGATGGT

CATGACTTACGTCAAGACATTATCGATTATGAAATTGTCCAGCATATCTTTGAGATCTTT

CGTTTGACTGTTCAGATGCGCAACAGCCTGTCAGAATTGGAGGATCGTGACTATGATCGC

CTTATTTCTCCCGTCTTAAATGAGAACAATATCTTCTACGACTCAGCCAAGGCTGGAGAT

GCACTGCCAAAAGACGCCGACGCAAATGGGGCCTACTGTATTGCATTGAAGGGGTTGTAC

GAGATCAAACAGATTACAGAAAATTGGAAGGAGGACGGTAAGTTCTCTCGTGATAAGCTG

AAGATTTCTAACAAAGACTGGTTCGATTTCATTCAGAACAAACGTTACCTGAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 67
AGCCCAGCGGCTAAAAAAAAGAAACTGGATGGCAGCGTGGATATGAACAACGGTACCAAT

AACTTTCAGAATTTCATTGGAATCAGCAGCTTACAGAAAACCCTGCGCAATGCACTTATC

CCCACTGAGACAACCCAGCAGTTCATTGTAAAGAACGGGATTATTAAAGAAGATGAGCTT

CGCGGGGAGAATCGTCAGATCTTAAAGGATATTATGGACGATTACTACCGTGGCTTCATT

TCGGAGACGCTGTCGTCGATCGACGACATCGACTGGACATCCTTGTTTGAAAAGATGGAA

ATCCAACTGAAGAATGGCGATAACAAGGACACGTTAATCAAAGAGCAGACGGAATACCGT

AAAGCTATCCACAAAAAGTTCGCTAATGACGACCGCTTTAAGAACATGTTCTCAGCAAAA

CTTATTAGCGATATTTTACCTGAATTTGTCATCCACAATAACAATTACTCCGCGAGTGAA

AAAGAGGAGAAAACCCAGGTGATTAAGCTGTTTTCCCGTTTTGCAACCAGTTTCAAGGAC

TATTTTAAGAATCGTGCTAATTGTTTCTCTGCAGACGACATTTCCTCGTCGTCCTGCCAT

CGCATTGTTAATGATAATGCTGAAATCTTTTTTTCAAACGCACTTGTGTATCGTCGCATT

GTCAAAAGCTTAAGTAATGACGATATCAATAAGATCTCAGGAGACATGAAGGACTCCCTG

AAAGAAATGTCATTGGAAGAAATTTACTCTTATGAAAAGTATGGAGAATTTATTACGCAG

GAGGGTATCAGCTTCTATAACGACATTTGTGGTAAAGTGAACAGCTTTATGAATCTTTAT

TGTCAAAAGAATAAAGAGAACAAAAATCTGTACAAGCTGCAGAAATTGCATAAACAAATT

CTGTGCATTGCAGATACTTCGTATGAGGTTCCTTACAAATTCGAGTCGGATGAGGAGGTG

-continued

TATCAAAGCGTAAACGGATTTTTGGATAACATTAGTAGTAAGCATATTGTGGAACGCCTT

CGCAAGATTGGTGACAACTATAACGGATACAACTTAGACAAGATCTATATTGTCTCGAAG

TTTTACGAAAGTGTTTCCCAAAAGACTTATCGCGACTGGGAGACAATCAACACTGCGCTG

GAAATTCACTATAACAATATCTTGCCGGGGAACGGAAAAAGTAAGGCAGATAAGGTGAAG

AAAGCAGTCAAAAATGATCTGCAAAAAAGCATTACTGAAATTAACGAACTTGTGTCAAAT

TACAAATTGTGTTCGGATGACAATATTAAAGCGGAAACGTATATCCACGAGATCTCGCAC

ATTCTTAATAATTTCGAGGCGCAGGAATTAAAGTATAATCCTGAGATCCATTTGGTGGAA

TCAGAACTTAAAGCTAGTGAACTGAAAAATGTCCTGGACGTTATTATGAATGCATTTCAC

TGGTGTTCTGTCTTTATGACAGAAGAACTTGTCGACAAAGACAACAACTTTTATGCGGAA

TTAGAAGAGATTTACGACGAAATTTATCCCGTTATTTCGTTATATAATTTAGTTCGTAAT

TACGTGACTCAGAAACCCTACAGCACAAAAAAGATTAAATTAAACTTTGGGATTCCGACT

CTTGCTGATGGATGGAGCAAGTCCAAGGAGTACTCTAATAACGCCATTATCTTGATGCGT

GACAACCTGTACTACCTGGGCATTTTTAACGCTAAAAACAAACCCGACAAAAAGATCATT

GAAGGGAACACCTCGGAAAATAAGGGGGACTATAAAAAAATGATCTACAATCTGTTGCCA

GGCCCAAATAAGATGATCCCAAAGGTTTTTTTATCTTCCAAAACTGGCGTAGAAACTTAC

AAGCCGAGCGCATACATCCTTGAAGGATATAAACAAAACAAACATATCAAAAGTTCAAAG

GACTTCGATATTACGTTCTGCCATGATTTAATCGATTATTTCAAGAATTGCATCGCGATT

CACCCAGAGTGGAAAAACTTTGGGTTTGATTTTTCAGACACCAGCACTTACGAGGATATT

AGTGGATTCTATCGTGAGGTTGAACTGCAGGGCTATAAAATTGACTGGACCTATATTTCT

GAAAAAGATATTGATCTGCTTCAGGAGAAAGGCCAATTGTACTTATTTCAAATCTATAAC

AAGGATTTCTCCAAGAAGTCCACGGGTAATGACAACTTACACACAATGTATCTGAAGAAT

CTGTTTAGTGAGGAGAACTTGAAGGACATTGTGCTGAAGCTTAATGGCGAGGCCGAAATC

TTTTTTCGTAAGTCCTCCATTAAAAACCCTATTATCCATAAGAAAGGGAGTATTCTTGTC

AACCGCACGTATGAGGCCGAAGAAAAGGACCAATTCGGAAACATCCAAATTGTCCGTAAA

AATATTCCTGAGAACATTTACCAGGAGCTTTACAAGTATTTCAACGACAAGAGTGATAAA

GAACTTTCAGATGAGGCGGCGAAACTGAAGAATGTAGTGGGGCACCACGAAGCTGCCACG

AATATTGTAAAGGATTACCGTTACACCTACGACAAGTACTTTTTGCATATGCCCATCACA

ATTAATTTTAAGGCCAATAAAACTGGTTTTATCAACGATCGTATCTTACAGTACATTGCT

AAGGAAAAAGATCTGCACGTTATCGGTATCGATCGCGGGGAACGCAATCTGATTTATGTT

AGTGTGATTGACACGTGCGGAAATATTGTTGAGCAGAAGAGCTTTAATATCGTAAATGGA

TATGACTATCAAATTAAACTGAAGCAACAGGAAGGGGCCCGCCAGATTGCCCGCAAGGAG

TGGAAAGAAATTGGAAAGATCAAGGAGATTAAAGAAGGGTACCTTTCCCTTGTTATCCAC

GAAATCTCGAAAATGGTGATCAAGTACAATGCCATTATTGCTATGGAGGATCTGTCATAT

GGGTTTAAGAAAGGCCGCTTTAAGGTGGAACGTCAGGTTTACCAGAAGTTTGAGACCATG

CTTATCAATAAGCTGAATTATCTTGTCTTCAAAGACATCTCAATCACAGAGAACGGCGGG

CTGTTAAAAGGATATCAGCTGACCTATATCCCCGACAAACTGAAAAATGTCGGGCACCAA

TGCGGCTGTATTTTCTACGTGCCCGCTGCATACACATCTAAAATTGACCCAACGACTGGA

TTCGTAAATATTTTTAAGTTTAAGGATCTTACGGTAGATGCAAAGCGCGAATTTATCAAG

AAATTTGATAGTATCCGTTACGACAGCGAGAAAAACTTATTTTGTTTTACGTTCGATTAT

AACAACTTCATCACGCAAAATACCGTCATGTCAAAATCTTCCTGGTCAGTCTATACGTAT

-continued

GGCGTCCGTATCAAGCGCCGCTTCGTCAACGGGCGTTTTTCAAACGAGTCAGATACCATC

GATATCACCAAAGATATGGAAAAAACATTGGAGATGACGGACATCAATTGGCGCGATGGT

CATGACTTACGCCAGGACATTATTGACTACGAAATCGTACAACATATTTTTGAGATTTTC

CGTCTGACCGTGCAAATGCGCAACTCATTATCCGAACTTGAGGATCGTGATTACGACCGC

TTGATCAGTCCTGTTCTGAACGAGAATAATATTTTTTACGACAGTGCCAAGGCGGGAGAC

GCACTGCCCAAGGACGCTGACGCTAACGGAGCTTATTGTATTGCGTTGAAGGGACTTTAC

GAAATCAAGCAAATCACTGAAAACTGGAAGGAGGATGGTAAATTCTCACGCGACAAGTTG

AAAATTTCGAACAAGGACTGGTTCGATTTCATCCAAAACAAGCGTTATTTAAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 68
AGCCCAGCGGCTAAAAAAAAGAAACTGGATGGCAGCGTGGATATGAACAACGGGACTAAT

AACTTCCAGAACTTCATCGGTATTTCATCATTACAAAAAACGCTTCGTAACGCCTTGATC

CCAACAGAAACGACCCAACAATTTATTGTAAAAAACGGCATCATCAAAGAAGACGAACTG

CGTGGCGAAAATCGCCAAATTTTGAAGGACATTATGGATGACTATTATCGTGGGTTTATC

TCGGAGACATTATCCTCCATCGACGACATTGATTGGACGAGTCTTTTTGAGAAAATGGAG

ATCCAGCTTAAAAATGGTGATAACAAGGATACATTGATCAAGGAGCAAACCGAGTACCGC

AAGGCCATCCATAAGAAGTTCGCAAATGACGACCGCTTCAAAAATATGTTTAGTGCCAAA

TTGATCTCGGATATCCTTCCTGAGTTCGTAATTCACAACAATAATTATAGCGCATCCGAA

AAGGAGGAAAAGACTCAAGTCATTAAGCTTTTCAGTCGCTTTGCTACCTCGTTTAAGGAC

TATTTCAAGAACCGCGCGAACTGCTTCTCAGCGGATGACATTTCTTCCTCGTCGTGTCAC

CGCATCGTGAATGATAATGCGGAGATCTTCTTTAGTAATGCCTTGGTATACCGCCGCATT

GTTAAATCCCTGTCTAACGACGATATCAATAAGATCTCAGGAGATATGAAGGATAGCCTT

AAAGAAATGTCTCTGGAAGAAATTTACTCCTATGAAAAGTACGGTGAGTTTATCACCCAA

GAGGGGATTAGCTTTTATAACGATATCTGCGGGAAGGTGAATTCGTTTATGAACCTTTAT

TGTCAAAAGAATAAGGAGAATAAGAACTTATATAAGCTTCAGAAACTGCATAAACAAATC

TTATGCATTGCCGATACTAGCTATGAAGTTCCGTATAAATTCGAGAGCGATGAAGAAGTT

TATCAGAGCGTCAATGGGTTCTTGGATAACATTTCATCAAAACACATCGTGGAACGTCTG

CGTAAGATTGGGGATAACTACAACGGATATAATCTTGACAAAATTTATATTGTATCTAAA

TTCTATGAGTCGGTGAGTCAAAAGACCTACCGTGATTGGGAAACAATCAATACCGCGTTA

GAAATCCACTATAACAACATTCTGCCAGGGAATGGTAAAAGTAAAGCGGACAAAGTCAAG

AAGGCTGTGAAGAACGATCTGCAAAAGAGTATTACAGAGATTAACGAATTAGTCTCCAAT

TATAAGTTATGCTCGGACGATAACATTAAGGCGGAGACGTATATTCATGAGATTTCGCAT

ATTCTTAACAACTTCGAGGCACAAGAGCTTAAGTATAACCCAGAGATTCACCTTGTCGAA

TCGGAGCTGAAGGCATCGGAATTAAAAAATGTCTTAGATGTAATCATGAACGCGTTCCAT

TGGTGCAGTGTTTTCATGACTGAGGAGTTAGTTGACAAGGACAATAACTTCTACGCAGAA

TTAGAAGAGATCTATGATGAGATTTATCCAGTGATTTCGCTGTATAATCTGGTACGTAAT

TACGTCACTCAAAAGCCCTACTCAACAAAAAAAATTAAGCTGAACTTCGGAATTCCGACT

CTGGCCGACGGGTGGTCCAAGTCAAAGGAGTATTCTAATAATGCTATCATCCTGATGCGC

GATAACTTATACTATTTGGGAATTTTCAATGCCAAAAATAAACCAGATAAAAAGATTATC

-continued

GAAGGTAATACAAGCGAGAATAAGGGTGACTATAAGAAAATGATTTACAATCTTCTTCCA

GGCCCTAACAAGATGATTCCCAAAGTTTTTTTGTCCAGTAAAACAGGGGTCGAAACTTAC

AAGCCCAGTGCCTATATCCTTGAAGGGTACAAGCAGAATAAGCACATCAAATCCTCGAAA

GACTTTGATATTACATTTTGTCATGACTTAATCGATTATTTTAAGAACTGTATCGCAATC

CATCCAGAATGGAAGAACTTCGGGTTTGATTTCTCTGATACTTCCACGTATGAGGATATT

TCCGGGTTCTACCGCGAAGTAGAGCTTCAGGGCTATAAAATTGACTGGACATATATTTCA

GAAAAAGACATCGATCTGTTACAAGAAAAAGGACAGTTGTATCTGTTTCAAATCTATAAT

AAGGATTTCTCCAAAAAGTCAACTGGAAATGATAACTTACATACAATGTATCTGAAAAAT

CTTTTTAGTGAAGAGAATTTGAAGGATATCGTGCTGAAGTTAAATGGCGAAGCAGAGATC

TTCTTCCGCAAGTCCTCGATCAAGAATCCTATCATCCACAAGAAAGGTAGTATTCTGGTT

AACCGCACGTACGAGGCCGAGGAAAAAGACCAGTTCGGTAATATCCAGATTGTACGTAAG

AATATTCCTGAAAATATTTACCAGGAATTATACAAGTATTTTAACGACAAATCGGATAAG

GAGCTTTCAGATGAGGCCGCAAAGTTGAAGAACGTCGTAGGACACCATGAGGCCGCTACG

AATATCGTCAAGGACTACCGCTATACGTATGACAAGTACTTCCTGCACATGCCTATTACT

ATCAATTTCAAAGCTAATAAAACAGGATTCATCAATGATCGTATCCTTCAGTACATTGCC

AAAGAAAAAGATCTGCACGTAATCGGAATCGACCGTGGCGAACGTAATCTGATTTACGTA

TCAGTTATCGACACATGTGGTAACATCGTGGAGCAGAAATCTTTTAACATTGTTAACGGC

TATGATTATCAGATTAAGCTTAAACAGCAGGAGGGGGCACGCCAAATCGCTCGTAAAGAA

TGGAAGGAGATTGGAAAGATTAAAGAGATTAAAGAGGGGTACCTTTCGCTGGTTATTCAC

GAAATTTCCAAGATGGTGATTAAGTACAATGCAATCATCGCGATGGAAGATCTTAGTTAC

GGATTCAAAAAGGGACGCTTCAAAGTTGAGCGTCAGGTCTACCAGAAATTTGAAACGATG

CTGATTAACAAATTGAATTACTTGGTATTCAAAGATATCTCAATTACTGAAAATGGTGGC

TTATTAAAGGGTTACCAGCTTACCTATATCCCGGATAAGCTGAAGAACGTGGGCCATCAA

TGCGGCTGCATCTTTTACGTCCCTGCCGCATATACCTCTAAAATTGACCCCACCACCGGA

TTCGTAAATATTTTTAAATTCAAGGACCTGACGGTGGACGCCAAGCGCGAATTCATCAAA

AAATTCGACTCAATCCGCTATGATTCCGAAAAAAATCTTTTCTGCTTTACGTTCGATTAT

AATAACTTCATTACCCAAAACACGGTGATGTCAAAATCGTCCTGGAGCGTGTATACTTAT

GGAGTGCGTATCAAGCGCCGCTTTGTTAATGGGCGCTTCAGTAACGAAAGCGATACCATC

GACATTACCAAAGACATGGAGAAGACGCTTGAAATGACGGATATCAATTGGCGTGACGGA

CACGATCTTCGTCAGGATATCATCGACTACGAGATTGTGCAACATATCTTTGAGATTTTC

CGTTTAACTGTTCAAATGCGTAACTCCTTGTCCGAATTGGAAGACCGTGATTACGACCGC

TTGATTTCACCAGTGCTTAACGAGAATAACATCTTCTACGACTCCGCCAAAGCAGGCGAT

GCCCTGCCAAAGGACGCTGATGCAAATGGTGCATACTGTATCGCGTTGAAGGGCTTATAC

GAGATTAAGCAAATCACCGAAAATTGGAAAGAGGATGGAAAGTTCAGTCGCGATAAGCTG

AAGATCTCTAATAAAGATTGGTTTGACTTTATCCAGAACAAACGTTATTTAAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 69
AGCCCAGCGGCTAAAAAAAAGAAACTGGATGGCAGCGTGGATATGAACAACGGTACCAAT

AATTTCCAAAATTTCATCGGAATCTCATCCTTGCAAAAAACCTTGCGCAATGCTTTGATC

-continued

CCCACCGAAACCACGCAGCAGTTCATCGTGAAAAACGGCATTATCAAAGAGGATGAGTTG

CGCGGGGAAAACCGTCAAATTCTTAAGGATATCATGGACGATTACTACCGTGGGTTTATC

AGTGAGACCCTGTCAAGCATTGACGACATTGACTGGACCAGCTTATTTGAGAAGATGGAG

ATTCAATTAAAGAACGGGGACAATAAGGACACGCTTATCAAAGAGCAGACAGAATACCGT

AAAGCGATTCATAAGAAATTTGCAAATGACGATCGCTTCAAGAACATGTTTTCAGCAAAA

TTAATCAGCGACATCCTTCCCGAATTTGTGATTCATAATAACAACTATTCGGCTAGCGAA

AAAGAGGAGAAAACTCAGGTTATTAAGCTTTTCTCGCGTTTTGCCACTTCGTTCAAAGAC

TATTTTAAGAATCGCGCAAACTGCTTTTCGGCTGATGATATTTCCAGTTCTAGCTGCCAT

CGTATCGTTAACGATAATGCTGAGATTTTCTTCTCTAATGCCCTGGTGTATCGTCGTATC

GTTAAATCTTTGAGCAACGACGATATTAATAAGATTTCAGGCGACATGAAGGATTCTTTA

AAGGAGATGTCTTTAGAAGAGATTTATTCCTATGAGAAATATGGCGAGTTTATCACCCAA

GAAGGAATTTCGTTCTACAACGACATCTGTGGCAAAGTGAACAGCTTCATGAATTTATAC

TGCCAAAAGAATAAGGAGAATAAAAATTTATATAAACTGCAGAAACTGCATAAGCAAATT

CTTTGCATTGCAGACACCTCTTATGAAGTTCCTTATAAGTTTGAATCGGACGAGGAGGTA

TATCAGAGTGTGAACGGGTTCCTGGACAATATTTCATCCAAGCATATTGTTGAACGTTTA

CGCAAAATTGGAGACAATTACAATGGGTATAACCTTGACAAAATTTACATCGTGTCGAAG

TTTTACGAATCGGTAAGCCAGAAGACCTATCGTGACTGGGAAACTATCAATACCGCCTTA

GAAATTCATTACAACAATATTCTTCCTGGTAACGGCAAAAGCAAAGCCGATAAGGTAAAG

AAGGCTGTCAAGAACGACCTGCAAAAGTCTATCACAGAGATCAACGAGTTAGTCTCTAAC

TACAAATTATGTTCCGACGACAATATTAAAGCCGAAACCTACATCCATGAGATCTCACAC

ATTCTTAACAATTTTGAGGCCCAGGAGCTGAAATATAACCCAGAAATTCACCTTGTAGAG

AGCGAATTAAAAGCCTCCGAGCTGAAGAACGTTTTGGATGTAATCATGAACGCATTTCAT

TGGTGCAGCGTATTTATGACAGAGGAGTTGGTCGACAAGGACAATAACTTTTACGCCGAG

CTTGAAGAAATCTACGATGAAATTTACCCGGTAATTAGTTTATATAATTTAGTTCGCAAC

TACGTAACTCAGAAACCCTACAGTACCAAGAAGATTAAATTGAACTTTGGGATCCCGACA

CTTGCTGACGGTTGGAGTAAATCAAAAGAATACTCCAATAATGCAATTATCCTGATGCGC

GACAATCTTTACTACTTGGGGATCTTTAACGCAAAGAACAAACCAGATAAGAAAATCATC

GAGGGCAACACCAGCGAGAATAAAGGCGATTACAAGAAAATGATCTATAATCTTTTGCCG

GGACCGAACAAAATGATCCCAAAGGTTTTCCTGTCGTCGAAAACGGGAGTCGAGACATAT

AAACCATCTGCGTACATCTTGGAAGGTTACAAACAGAATAAGCATATTAAGTCTAGTAAA

GACTTCGACATCACCTTTTGTCATGACCTGATTGATTATTTCAAGAACTGTATTGCTATC

CATCCAGAATGGAAAAACTTCGGATTTGACTTCTCCGATACTAGCACCTACGAAGACATT

TCGGGTTTTTATCGCGAAGTAGAGCTTCAAGGGTACAAAATTGATTGGACATATATTAGC

GAGAAAGACATTGATTTGCTTCAAGAGAAGGGACAGTTATATTTATTCCAGATCTACAAC

AAAGACTTCTCGAAGAAATCCACCGGTAATGATAATCTTCACACTATGTACCTGAAGAAT

TTATTTTCAGAGGAAAATCTGAAGGACATTGTACTTAAACTTAATGGAGAAGCCGAAATC

TTCTTCCGCAAGAGTTCCATTAAAAATCCGATTATTCATAAAAAGGGAAGTATCCTTGTG

AACCGCACGTATGAGGCCGAAGAGAAGGATCAGTTTGGGAATATTCAAATTGTCCGCAAA

AACATCCCCGAGAACATCTACCAGGAACTGTATAAATACTTTAATGATAAATCTGATAAA

GAGTTATCAGACGAGGCTGCCAAACTGAAAAACGTAGTCGGTCATCATGAGGCAGCGACC

AATATTGTAAAGGACTACCGTTACACCTACGACAAGTATTTCCTTCACATGCCGATCACG

-continued

ATTAATTTTAAGGCTAACAAGACCGGCTTTATCAATGACCGCATCTTGCAGTACATCGCG

AAAGAGAAAGATTTACACGTCATCGGAATTGATCGTGGAGAGCGTAATCTTATCTACGTC

AGCGTCATCGACACCTGTGGAAACATTGTGGAACAAAAAAGTTTTAATATCGTAAACGGC

TACGACTATCAAATTAAACTTAAACAGCAAGAGGGAGCTCGCCAGATCGCTCGCAAAGAG

TGGAAAGAGATTGGGAAAATTAAAGAAATTAAAGAGGGTTACCTGTCGCTGGTAATTCAC

GAAATCTCGAAAATGGTCATCAAATATAATGCAATTATCGCTATGGAGGATCTGTCCTAC

GGGTTCAAGAAGGGACGTTTTAAAGTAGAGCGCCAGGTGTATCAAAAATTCGAAACCATG

TTGATCAATAAGCTTAACTATTTGGTCTTCAAAGATATTTCGATTACGGAGAACGGAGGT

TTGTTGAAAGGATATCAGCTGACGTATATCCCAGACAAGTTGAAAAACGTGGGGCATCAA

TGTGGATGTATTTTCTATGTGCCCGCGGCCTACACGAGTAAGATCGATCCTACCACTGGT

TTCGTCAACATTTTCAAATTTAAAGATCTTACCGTGGATGCGAAGCGCGAATTTATTAAG

AAATTTGATAGCATTCGCTATGATTCCGAAAAGAACCTGTTCTGTTTTACGTTCGACTAT

AACAATTTCATTACCCAAAACACGGTGATGAGCAAATCCTCTTGGTCAGTTTATACATAC

GGTGTACGTATCAAACGCCGTTTCGTTAACGGACGCTTTTCCAATGAGTCTGATACAATC

GATATCACGAAAGATATGGAAAAAACATTAGAGATGACTGATATCAACTGGCGTGACGGG

CACGACCTGCGTCAAGACATTATTGACTACGAGATTGTGCAGCATATCTTCGAAATCTTT

CGCTTAACTGTGCAAATGCGTAACTCGTTATCCGAGTTAGAAGACCGTGACTACGATCGC

CTGATTTCACCCGTCTTGAACGAAAATAACATCTTCTACGATTCCGCGAAGGCTGGGGAC

GCATTGCCCAAGGACGCAGACGCGAATGGAGCGTACTGTATTGCGCTTAAAGGATTATAT

GAAATCAAGCAGATCACCGAAAATTGGAAGGAGGACGGGAAGTTCTCACGCGACAAACTG

AAGATTTCAAATAAGGACTGGTTCGATTTCATTCAGAATAAGCGTTACCTGAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 70
AGCCCAGCGGCTAAAAAAAAGAAACTGGATGGCAGCGTGGATATGAATAATGGTACGAAC

AACTTTCAGAACTTCATCGGCATCTCCAGCCTTCAAAAGACTTTACGCAACGCATTGATT

CCCACGGAGACTACGCAACAGTTTATCGTAAAAAATGGTATTATCAAAGAAGATGAATTA

CGCGGGGAGAATCGCCAGATTCTTAAGGACATTATGGACGATTATTACCGTGGATTCATC

AGTGAGACACTGAGCTCCATTGATGACATCGACTGGACGTCATTGTTTGAAAAGATGGAA

ATCCAGTTGAAAAATGGCGATAACAAAGATACATTGATTAAAGAGCAGACAGAGTACCGC

AAAGCAATTCACAAGAAATTCGCCAATGATGATCGTTTTAAGAACATGTTTAGTGCCAAG

CTTATTTCGGATATCTTACCCGAATTCGTGATTCACAACAACAATTATTCGGCAAGTGAG

AAAGAGGAAAAGACCCAGGTTATCAAATTGTTTTCGCGCTTCGCCACTTCGTTCAAAGAT

TATTTCAAGAACCGTGCAAACTGTTTCTCCGCTGACGACATCAGTTCCAGCTCATGCCAC

CGTATTGTAAATGACAATGCGGAGATCTTTTTCAGTAATGCCTTAGTATATCGTCGCATT

GTAAAGAGCTTATCTAATGATGACATTAACAAGATCTCGGGTGATATGAAGGACTCACTT

AAGGAGATGAGTCTGGAAGAGATCTACTCCTACGAAAAATACGGGGAATTCATCACCCAG

GAGGGAATTTCATTCTACAACGATATCTGCGGCAAAGTTAACTCCTTTATGAATCTGTAC

TGTCAAAAGAACAAGGAGAATAAAAACCTGTATAAATTGCAGAAACTTCATAAACAAATT

TTGTGTATCGCAGACACGAGTTATGAAGTACCTTATAAATTCGAATCCGACGAAGAGGTA

-continued

TATCAGTCCGTAAATGGGTTCCTGGACAATATCAGTAGTAAGCACATTGTGGAACGCTTA

CGCAAAATTGGAGACAATTACAACGGGTATAACCTGGACAAAATCTACATCGTATCCAAA

TTTTATGAAAGCGTGTCTCAAAAAACTTATCGTGATTGGGAAACAATCAACACGGCTCTT

GAGATCCATTACAATAACATCTTGCCGGGTAACGGCAAATCGAAGGCAGACAAAGTTAAA

AAAGCAGTTAAGAACGACTTACAGAAAAGCATTACGGAGATTAACGAGTTAGTAAGTAAT

TACAAATTATGCTCCGACGATAATATCAAAGCTGAAACCTACATCCATGAAATTAGCCAC

ATTTTGAACAATTTCGAAGCGCAGGAGCTGAAATATAACCCTGAAATCCATCTGGTAGAG

TCTGAGTTGAAGGCGTCAGAACTGAAAAACGTTCTTGACGTCATCATGAATGCCTTTCAC

TGGTGTAGTGTTTTTATGACTGAGGAGCTTGTAGATAAGGACAACAACTTCTATGCTGAA

CTTGAAGAGATCTACGATGAAATCTACCCCGTAATCAGTCTGTATAATTTAGTTCGTAAC

TACGTCACGCAGAAACCCTATTCGACTAAGAAAATTAAGCTGAACTTTGGGATCCCTACT

TTGGCAGACGGGTGGAGCAAGAGTAAAGAATACAGTAATAATGCAATTATCTTGATGCGC

GATAACTTATATTACTTAGGTATTTTCAATGCTAAGAACAAACCTGATAAGAAGATTATC

GAAGGAAATACGAGTGAGAATAAGGGAGACTACAAAAAGATGATTTACAACTTGCTGCCA

GGGCCTAATAAGATGATTCCAAAAGTTTTTCTGTCGAGCAAGACAGGGGTTGAAACTTAT

AAGCCATCCGCTTATATCCTTGAGGGGTACAAGCAGAATAAGCATATCAAGTCCTCCAAA

GATTTTGATATTACATTTTGCCACGACTTAATTGATTACTTCAAGAACTGCATCGCAATC

CATCCCGAATGGAAGAATTTCGGCTTCGATTTCTCAGATACGTCCACGTATGAGGATATC

TCAGGCTTTTACCGCGAAGTTGAGCTGCAAGGTTATAAAATTGATTGGACATACATCTCC

GAAAAAGACATTGATCTTTTACAGGAAAAGGGCCAATTATACTTATTTCAAATCTATAAC

AAAGATTTTAGCAAGAAGTCCACAGGTAATGATAACCTGCATACGATGTATTTGAAAAAT

CTTTTCAGTGAAGAGAATTTGAAGGATATCGTCCTGAAGCTGAACGGTGAGGCTGAGATC

TTCTTCCGCAAATCGTCTATCAAAAACCCCATCATTCACAAAAAGGGAAGTATCTTAGTA

AACCGCACTTATGAAGCGGAGGAAAAGGATCAGTTCGGGAACATCCAGATCGTGCGCAAG

AACATTCCAGAAAACATCTATCAGGAACTTTACAAATATTTCAATGACAAGTCTGATAAA

GAATTATCAGACGAGGCGGCGAAACTTAAAAATGTTGTTGGACACCACGAAGCAGCGACG

AATATTGTAAAGGATTATCGCTACACATACGATAAATACTTTTTGCACATGCCAATCACC

ATTAACTTTAAGGCGAACAAGACAGGTTTCATTAACGACCGTATTCTGCAATATATCGCA

AAGGAAAAAGACCTGCACGTTATTGGGATCGATCGTGGCGAACGCAATTTGATCTACGTA

AGCGTTATCGACACTTGCGGAAATATCGTTGAACAAAAAAGCTTTAATATCGTCAATGGA

TACGATTACCAAATCAAGCTGAAACAACAAGAAGGGGCACGTCAGATCGCTCGTAAAGAA

TGGAAAGAGATTGGTAAGATCAAAGAGATTAAAGAAGGGTATCTTTCTTTAGTAATTCAC

GAGATTTCGAAAATGGTTATTAAATACAATGCGATTATTGCTATGGAAGACTTAAGCTAC

GGCTTTAAGAAAGGTCGCTTCAAAGTGGAGCGCCAAGTGTATCAGAAGTTTGAAACGATG

TTGATTAACAAATTAAATTACCTGGTCTTTAAGGACATCAGTATCACAGAAAATGGGGGG

TTGCTTAAAGGGTACCAGCTTACATACATCCCTGATAAACTGAAAAATGTCGGTCATCAG

TGCGGATGTATCTTCTATGTACCAGCAGCCTATACCAGTAAGATTGACCCTACTACTGGC

TTTGTGAATATTTTTAAATTCAAGGATTTAACCGTGGACGCCAAGCGTGAATTTATTAAA

AAATTTGATTCGATTCGCTACGACAGTGAGAAAAACCTTTTCTGCTTTACCTTTGACTAC

AACAATTTTATTACCCAGAACACCGTAATGTCAAAGAGTTCGTGGTCTGTATATACCTAC

-continued

GGTGTTCGCATCAAGCGCCGCTTCGTAAACGGGCGTTTCAGTAACGAATCTGACACCATC

GACATCACTAAAGATATGGAGAAGACATTGGAAATGACGGACATTAATTGGCGTGATGGC

CATGACTTACGTCAGGACATTATTGATTACGAAATTGTGCAGCATATCTTCGAGATTTTC

CGTTTGACAGTTCAGATGCGCAACTCACTGAGTGAGTTAGAAGATCGCGATTACGACCGT

CTGATCTCACCGGTCCTTAATGAAAACAACATTTTCTACGACTCAGCAAAGGCGGGTGAT

GCCCTGCCAAAGGATGCGGACGCTAATGGCGCCTACTGCATCGCCCTGAAAGGATTGTAT

GAAATTAAGCAGATTACAGAAAATTGGAAGGAAGATGGTAAATTTAGCCGTGATAAATTA

AAAATCTCGAACAAGGATTGGTTCGATTTTATTCAGAACAAACGTTATTTGAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 71

AGCCCAGCGGCTAAAAAAAAGAAACTGGATGGCAGCGTGGATATGAACAATGGAACAAAT

AATTTTCAAAATTTTATCGGCATCTCAAGTCTTCAAAAAACCCTTCGCAATGCCCTGATT

CCAACTGAAACAACCCAGCAATTTATCGTCAAGAACGGCATCATTAAGGAAGACGAGTTA

CGCGGGGAGAACCGTCAAATCCTGAAAGATATCATGGATGACTACTATCGTGGGTTCATT

TCGGAAACCTTGTCTTCAATCGACGACATTGACTGGACGAGTCTTTTCGAGAAAATGGAA

ATTCAGCTTAAAAATGGAGACAACAAGGATACTCTGATTAAGGAACAGACAGAATATCGC

AAAGCTATCCACAAAAAGTTCGCTAATGATGATCGTTTCAAAAATATGTTTTCTGCTAAA

TTGATTTCCGATATCTTGCCTGAATTTGTAATCCACAACAACAATTATTCTGCTTCCGAG

AAGGAAGAGAAGACCCAGGTCATTAAATTATTCAGCCGCTTTGCAACCAGCTTTAAAGAC

TACTTTAAGAATCGCGCTAACTGCTTTTCGGCGGATGACATCTCATCATCATCATGCCAC

CGCATTGTGAACGACAATGCGGAGATCTTCTTTTCGAATGCGTTAGTTTATCGTCGCATT

GTCAAAAGTCTTAGCAATGATGACATCAACAAGATCTCAGGAGACATGAAAGATTCCTTA

AAGGAGATGTCTCTTGAGGAAATCTATTCGTATGAGAAATACGGCGAGTTCATTACCCAG

GAAGGTATTAGTTTCTACAATGATATCTGCGGCAAAGTAAATTCTTTTATGAATCTGTAT

TGCCAAAAAAACAAAGAAAACAAGAATCTTTATAAGTTACAAAAGTTACATAAGCAAATT

CTGTGCATCGCTGATACATCTTATGAGGTACCCTACAAATTTGAAAGTGATGAGGAGGTC

TATCAGAGTGTCAACGGCTTCTTAGACAACATCTCTTCCAAACATATCGTGGAACGCCTG

CGTAAAATCGGAGATAACTACAACGGATATAACTTAGATAAAATCTACATCGTGTCCAAG

TTTTATGAAAGTGTGAGCCAAAAAACATATCGTGACTGGGAAACCATTAACACCGCATTG

GAAATTCACTATAACAACATTTTGCCAGGCAACGGGAAAAGTAAGGCGGACAAAGTTAAG

AAAGCAGTTAAAAATGACCTGCAAAAAAGCATCACTGAAATTAACGAATTGGTATCGAAT

TACAAATTATGTAGCGACGATAATATCAAAGCAGAAACTTACATTCACGAGATTAGTCAC

ATTTTAAATAACTTCGAGGCCCAGGAATTGAAATACAATCCCGAAATTCATTTGGTTGAA

TCAGAACTGAAAGCATCAGAGTTGAAAAATGTGTTAGATGTCATTATGAATGCGTTTCAT

TGGTGCTCTGTGTTCATGACCGAGGAACTGGTTGATAAAGATAACAACTTTTACGCTGAA

TTGGAGGAGATTTACGATGAGATTTACCCGGTCATTTCGCTTTATAACTTAGTGCGCAAT

TATGTGACGCAGAAACCATATTCCACGAAGAAAATCAAACTTAATTTTGGCATCCCTACT

CTGGCTGATGGTTGGTCGAAATCGAAAGAGTACAGCAACAACGCGATCATTCTTATGCGT

GACAATCTTTACTATTTGGGCATTTTTAATGCCAAGAATAAGCCAGATAAGAAAATCATT

-continued

GAGGGGAATACTTCCGAGAATAAGGGGGATTACAAAAAGATGATCTATAACTTGCTGCCC

GGCCCCAACAAAATGATTCCTAAGGTTTTCTTGTCAAGCAAGACGGGCGTCGAAACATAT

AAGCCGTCAGCTTATATTCTGGAAGGCTATAAACAGAATAAGCACATCAAGTCTTCCAAG

GACTTTGACATCACTTTTTGCCACGATTTGATCGACTACTTTAAGAACTGTATTGCGATT

CATCCGGAATGGAAGAACTTCGGTTTCGACTTTTCCGATACCTCAACATACGAGGATATC

AGCGGCTTCTACCGTGAAGTCGAGCTTCAAGGCTACAAGATCGATTGGACATATATTTCA

GAGAAGGACATTGATTTGTTACAAGAGAAAGGTCAACTTTACTTATTTCAGATCTATAAC

AAAGACTTTTCGAAGAAATCGACAGGAAACGATAACTTACACACTATGTATTTAAAAAAT

CTGTTTTCGGAGGAAAACCTGAAAGATATTGTGCTGAAACTTAACGGCGAGGCAGAGATC

TTTTTCCGTAAAAGCTCAATCAAGAATCCTATCATCCATAAAAAAGGTAGTATTCTTGTC

AACCGCACATATGAAGCGGAGGAGAAGGACCAATTCGGAAACATCCAAATTGTCCGTAAG

AATATTCCGGAGAACATTTACCAAGAGTTGTATAAATACTTTAACGATAAGTCAGATAAG

GAACTTAGCGATGAGGCGGCGAAGCTTAAAAACGTAGTTGGGCATCATGAAGCTGCTACC

AACATTGTAAAAGATTACCGTTACACCTATGACAAGTATTTCTTGCACATGCCCATTACG

ATCAATTTCAAAGCAAATAAGACAGGCTTTATCAATGATCGCATCCTGCAGTACATTGCT

AAAGAGAAGGATTTGCATGTTATCGGTATTGATCGCGGAGAGCGCAATTTGATCTACGTC

TCCGTAATCGACACTTGCGGTAACATTGTTGAGCAGAAGTCGTTCAACATCGTTAATGGT

TATGATTACCAAATCAAGCTGAAGCAGCAAGAGGGTGCCCGCCAGATCGCGCGTAAGGAA

TGGAAAGAAATCGGGAAAATTAAAGAGATCAAAGAAGGCTATTTGTCTCTGGTAATTCAC

GAAATCAGCAAGATGGTGATCAAGTATAACGCGATCATTGCGATGGAGGATCTTTCTTAT

GGCTTCAAGAAAGGGCGCTTTAAAGTCGAACGCCAGGTCTACCAGAAATTTGAGACAATG

CTTATCAACAAGCTTAACTATCTTGTATTTAAGGATATTTCCATCACTGAGAACGGAGGA

CTTTTAAAGGGGTACCAACTGACGTACATTCCTGATAAGCTGAAGAACGTTGGTCATCAA

TGCGGATGCATCTTCTATGTGCCAGCGGCTTACACCTCCAAAATCGATCCCACTACAGGC

TTTGTCAATATCTTCAAATTCAAGGATTTGACCGTTGACGCGAAGCGCGAGTTTATCAAG

AAGTTTGATAGCATTCGCTACGACAGCGAAAAAAATTTATTTTGTTTTACTTTCGACTAC

AATAACTTTATTACTCAGAACACTGTCATGTCAAAGAGTTCGTGGAGTGTCTACACGTAC

GGAGTACGTATTAAGCGCCGTTTCGTCAACGGACGCTTCTCAAACGAAAGCGACACGATC

GACATCACCAAAGACATGGAAAAAACTCTTGAGATGACGGATATCAATTGGCGCGACGGC

CATGACCTGCGTCAGGATATCATTGATTACGAGATCGTTCAGCACATCTTCGAAATCTTC

CGCCTTACCGTCCAGATGCGCAACAGTTTAAGCGAGCTTGAAGACCGCGACTACGATCGT

TTGATTAGCCCCGTTCTGAACGAGAATAATATTTTCTACGACAGCGCAAAGGCCGGTGAT

GCTTTGCCAAAGGACGCAGACGCGAATGGAGCCTACTGCATCGCCCTGAAGGGCTTATAT

GAGATTAAGCAAATTACCGAAAATTGGAAGGAAGATGGTAAGTTCTCCCGTGATAAGCTT

AAAATTAGCAATAAGGATTGGTTCGACTTCATCCAGAACAAACGTTACCTGAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 72
AGCCCAGCGGCTAAAAAAAAGAAACTGGATGGCAGCGTGGATATGAACAACGGAACAAAC

AATTTCCAAAACTTCATCGGTATCTCTTCGTTGCAGAAGACTCTGCGTAATGCTTTGATC

-continued

CCGACGGAGACAACCCAACAATTTATCGTCAAAAACGGTATTATTAAGGAGGACGAGTTA

CGTGGAGAAAATCGTCAAATCCTTAAGGACATCATGGACGATTATTATCGCGGGTTTATT

TCTGAAACCCTGAGCAGTATCGATGATATCGACTGGACCTCACTTTTTGAGAAAATGGAG

ATCCAGTTGAAGAACGGTGATAACAAAGACACTCTGATCAAAGAGCAAACTGAATACCGC

AAGGCAATTCACAAAAAGTTCGCCAACGACGACCGTTTCAAGAATATGTTCTCAGCTAAG

TTAATCAGCGACATTTTGCCAGAGTTCGTTATCCACAACAATAATTATAGTGCTTCAGAG

AAGGAGGAAAAAACCCAAGTGATTAAACTTTTTTCGCGCTTTGCAACCTCATTCAAGGAC

TACTTCAAGAATCGCGCGAATTGCTTCAGTGCGGACGACATTTCTTCTTCAAGTTGCCAT

CGTATCGTTAACGATAACGCGGAAATTTTCTTCTCTAATGCTTTGGTGTATCGCCGCATT

GTAAAATCGCTTAGTAACGATGACATTAATAAGATCTCAGGTGATATGAAAGATTCATTG

AAGGAAATGAGCTTGGAAGAGATTTACAGTTACGAAAAATATGGAGAATTTATTACTCAG

GAAGGCATCTCATTCTATAACGATATCTGCGGGAAGGTAAATTCGTTTATGAACTTATAT

TGCCAGAAAAATAAAGAGAATAAAAATTTGTATAAGCTTCAGAAGTTGCACAAACAGATC

CTGTGCATTGCAGACACCTCGTATGAGGTTCCGTATAAATTTGAGTCCGATGAAGAAGTG

TATCAGTCTGTGAATGGTTTCTTAGATAATATCTCTTCCAAGCATATTGTCGAACGCCTG

CGCAAAATTGGTGATAACTATAACGGATACAATCTGGATAAAATTTACATCGTTTCTAAA

TTTTACGAGTCAGTCTCGCAGAAGACCTACCGCGACTGGGAAACAATTAACACGGCATTG

GAGATTCACTACAATAATATCTTGCCTGGTAACGGTAAGTCTAAGGCAGATAAGGTAAAA

AAAGCTGTGAAAAACGACCTTCAGAAAAGCATCACGGAGATTAATGAGCTGGTGAGTAAT

TACAAATTATGTTCAGACGATAATATTAAAGCTGAAACGTATATCCATGAAATCTCGCAT

ATCTTGAACAACTTCGAGGCCCAAGAACTTAAATATAACCCCGAAATCCATTTAGTCGAG

TCTGAATTGAAAGCGTCGGAATTAAAAAACGTCTTAGACGTCATTATGAACGCGTTTCAC

TGGTGTTCAGTTTTCATGACCGAAGAGCTGGTCGACAAAGACAACAACTTCTATGCGGAA

TTGGAGGAAATCTATGATGAAATCTACCCTGTTATTTCACTGTATAACCTTGTGCGCAAC

TATGTCACTCAGAAGCCGTATTCGACCAAAAAAATTAAATTGAATTTCGGTATCCCTACT

CTTGCAGACGGATGGAGTAAAAGCAAGGAATACAGTAATAACGCCATTATTCTTATGCGC

GACAATTTATACTACCTGGGCATCTTTAACGCAAAGAATAAGCCGGATAAGAAGATTATT

GAGGGTAACACCAGTGAGAACAAGGGCGACTATAAGAAGATGATCTATAACTTATTGCCA

GGTCCAAATAAAATGATCCCAAAAGTATTCTTATCATCAAAGACGGGAGTTGAAACCTAT

AAGCCTAGTGCCTATATTCTTGAGGGATATAAACAGAACAAGCACATTAAGTCGTCTAAG

GATTTTGACATTACGTTCTGCCATGACTTAATCGACTATTTTAAAAACTGTATTGCGATT

CACCCCGAATGGAAGAATTTTGGATTCGATTTTTCGGATACCTCGACCTATGAAGATATT

TCGGGATTTTATCGTGAAGTGGAGTTGCAAGGCTATAAAATCGATTGGACCTATATCTCA

GAAAAAGACATTGATTTATTACAGGAAAAGGGACAACTGTACCTTTTCCAAATTTATAAC

AAGGACTTTTCTAAAAAGTCCACAGGAAATGATAACCTTCACACCATGTACCTGAAGAAC

CTTTTCTCAGAGGAAAACCTGAAGGACATTGTCCTTAAGTTAAATGGAGAAGCGGAGATC

TTTTTCCGTAAATCTAGTATCAAGAATCCGATTATCCATAAAAAAGGTTCGATTTTGGTA

AATCGCACCTATGAAGCGGAAGAGAAAGATCAATTTGGTAACATCCAGATCGTGCGCAAG

AATATCCCGGAGAACATTTACCAAGAGCTGTATAAGTACTTCAATGATAAGTCTGATAAG

GAACTGTCAGATGAAGCTGCGAAATTGAAGAACGTGGTTGGGCATCATGAAGCCGCTACC

AATATCGTCAAGGATTACCGTTATACCTATGACAAATATTTCTTACACATGCCGATTACG

-continued

ATCAATTTTAAGGCAAACAAGACAGGATTCATCAACGACCGTATCTTGCAGTATATTGCC

AAAGAGAAGGATCTGCATGTGATCGGTATTGACCGCGGGGAGCGCAATTTAATCTATGTA

TCGGTGATCGATACTTGTGGTAACATCGTAGAACAAAAGAGCTTTAACATCGTGAATGGT

TACGACTATCAGATCAAGCTGAAACAACAGGAAGGAGCCCGCCAGATCGCTCGCAAGGAA

TGGAAAGAAATCGGGAAAATTAAGGAAATCAAGGAAGGCTACCTTTCATTGGTCATTCAC

GAAATTTCGAAAATGGTAATTAAGTACAACGCGATCATCGCCATGGAGGACCTTTCGTAC

GGATTTAAGAAGGGTCGTTTCAAAGTTGAGCGCCAGGTATACCAAAAATTCGAGACTATG

CTTATCAACAAACTTAACTACTTGGTCTTTAAGGACATTTCTATTACCGAAAACGGCGGC

TTACTTAAAGGCTATCAATTGACATATATTCCCGACAAACTGAAGAATGTTGGACATCAA

TGCGGGTGTATTTTCTATGTGCCGGCAGCTTACACTAGTAAGATCGACCCTACAACCGGG

TTCGTAAACATTTTTAAATTCAAAGACTTAACAGTCGATGCGAAGCGTGAATTTATTAAG

AAGTTTGATAGTATCCGCTATGACAGTGAAAAGAACTTGTTTTGCTTTACGTTCGACTAC

AATAACTTTATTACACAGAACACGGTCATGTCTAAATCATCATGGTCGGTTTACACATAT

GGGGTGCGCATCAAGCGTCGCTTTGTAAATGGCCGTTTTAGTAATGAGAGCGACACAATC

GACATCACAAAGGATATGGAGAAAACTCTTGAGATGACAGACATCAATTGGCGTGACGGT

CATGACTTACGCCAAGATATCATCGACTACGAAATCGTACAGCATATTTTTGAGATTTTT

CGTCTTACTGTGCAAATGCGTAATTCTTTATCCGAACTGGAAGATCGTGATTACGACCGC

TTGATTAGTCCCGTCTTAAATGAGAACAATATTTTCTATGATTCTGCGAAAGCCGGAGAT

GCACTGCCCAAAGACGCTGATGCCAATGGCGCGTATTGCATTGCATTAAAAGGATTATAT

GAGATTAAACAGATTACCGAAAATTGGAAAGAGGACGGTAAATTCTCACGCGATAAATTG

AAGATTTCTAACAAGGACTGGTTCGACTTTATCCAAAATAAACGTTATCTTAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 73
AGCCCAGCGGCTAAAAAAAAGAAACTGGATGGCAGCGTGGATATGAATAACGGTACCAAC

AACTTTCAGAATTTCATTGGCATTAGCTCGCTTCAAAAAACTTTACGCAATGCTCTTATT

CCGACTGAGACGACACAACAGTTTATCGTTAAGAATGGCATCATCAAAGAAGATGAATTA

CGCGGAGAAAACCGCCAGATCCTGAAAGACATTATGGACGATTATTACCGTGGGTTCATC

TCCGAGACGTTGTCATCGATCGATGACATCGACTGGACGTCACTTTTTGAAAAAAATGGAG

ATCCAGTTAAAGAACGGTGACAATAAGGATACATTGATCAAAGAACAGACCGAGTACCGT

AAAGCGATTCATAAAAAGTTTGCGAACGATGATCGCTTCAAGAATATGTTTTCTGCGAAA

TTAATTTCCGACATTTTACCTGAATTTGTTATTCATAATAACAACTACTCGGCGTCTGAG

AAAGAGGAGAAAACCCAAGTGATTAAACTTTTTTCACGTTTCGCAACGTCGTTCAAAGAC

TATTTTAAAAATCGTGCTAATTGCTTTAGCGCGGATGACATCAGCTCTAGTTCATGTCAT

CGCATTGTCAACGATAATGCTGAGATCTTTTTCAGTAATGCGTTAGTGTACCGTCGTATT

GTGAAGTCCTTATCTAATGATGATATCAATAAGATCAGCGGGGATATGAAGGACTCACTT

AAGGAGATGAGCTTGGAGGAAATCTATTCCTATGAGAAGTATGGTGAGTTTATTACGCAA

GAAGGAATTAGCTTTTACAACGATATCTGTGGAAAGGTGAATTCGTTTATGAATTTGTAT

TGCCAGAAAAATAAGGAGAACAAGAACCTTTATAAATTGCAAAAGTTACACAAGCAAATC

CTGTGCATTGCAGATACTTCCTACGAGGTGCCTTACAAGTTTGAATCCGACGAAGAGGTC

TACCAATCTGTAAACGGTTTCTTAGATAATATTAGTTCCAAGCATATTGTGGAGCGCCTT
CGTAAAATTGGCGATAATTACAACGGTTACAATTTAGACAAAATTTACATTGTCAGTAAA
TTCTACGAGTCCGTATCTCAAAAGACGTATCGTGATTGGGAGACTATCAATACGGCCCTG
GAGATCCACTACAACAATATCTTGCCCGGTAATGGTAAGTCGAAGGCCGATAAAGTTAAG
AAAGCGGTGAAAAATGACTTACAGAAGTCAATCACCGAAATTAACGAATTGGTGTCCAAT
TATAAATTGTGTTCAGATGATAATATCAAAGCCGAGACCTACATTCATGAGATTTCCCAT
ATCTTAAATAATTTCGAGGCGCAAGAGCTTAAGTATAACCCAGAAATCCACCTGGTAGAA
TCTGAGTTGAAGGCGTCAGAGTTAAAAAATGTTTTAGATGTCATTATGAACGCGTTTCAC
TGGTGCTCCGTATTTATGACGGAGGAATTAGTAGATAAAGACAACAATTTCTATGCCGAA
CTTGAGGAAATCTATGATGAGATCTATCCCGTCATTAGCCTGTATAACTTGGTCCGCAAC
TATGTTACCCAAAAACCGTACAGTACCAAGAAGATTAAGCTGAATTTCGGCATTCCTACA
CTGGCTGATGGTTGGAGTAAATCGAAGGAATATTCGAATAACGCGATTATCTTGATGCGC
GACAACTTATACTATTTGGGGATCTTTAACGCCAAAAACAAACCGGATAAGAAGATTATT
GAGGGAAACACATCAGAGAACAAAGGCGACTACAAAAAAATGATTTACAACTTGTTACCG
GGGCCTAACAAAATGATCCCGAAGGTGTTCTTATCCAGTAAAACAGGCGTTGAGACCTAC
AAACCTTCCGCATACATCCTGGAAGGGTATAAGCAGAACAAGCACATTAAGTCCAGCAAG
GATTTCGATATTACCTTCTGTCATGATTTAATTGACTATTTCAAGAACTGTATTGCAATC
CACCCCGAGTGGAAGAACTTCGGATTCGACTTCTCAGATACGAGCACATATGAGGACATC
TCGGGGTTCTATCGTGAAGTAGAACTGCAGGGATATAAAATTGATTGGACATATATTTCC
GAAAAAGACATCGACCTTTTACAAGAGAAGGGTCAACTTTACTTGTTCCAAATTTACAAT
AAAGACTTCTCAAAAAAAAGCACGGGTAACGATAATTTACACACTATGTATTTAAAGAAC
CTTTTCTCGGAAGAGAATTTAAAGGATATCGTATTGAAGTTGAATGGAGAAGCGGAGATC
TTCTTCCGTAAGTCCAGTATTAAAAACCCTATTATTCACAAGAAGGGATCGATTTTAGTT
AACCGCACATACGAGGCCGAAGAGAAGGACCAATTTGGGAACATTCAAATTGTCCGCAAA
AACATCCCTGAGAACATTTATCAAGAGCTTTATAAGTACTTTAACGATAAGTCCGATAAG
GAATTGTCAGATGAGGCGGCAAAGTTGAAGAATGTCGTGGGGCATCATGAAGCTGCCACC
AACATTGTGAAGGACTACCGCTACACTTACGACAAATACTTCCTGCACATGCCCATTACG
ATCAATTTTAAGGCCAATAAGACAGGCTTTATTAACGACCGTATTCTTCAATATATCGCT
AAGGAGAAGGACCTTCATGTGATTGGGATCGACCGCGGAGAACGTAATTTAATTTATGTG
TCCGTCATCGATACGTGTGGAAATATCGTGGAACAGAAATCATTCAATATCGTGAATGGC
TATGATTACCAGATCAAATTAAAACAGCAGGAGGGCGCTCGCCAAATTGCGCGTAAGGAA
TGGAAAGAGATCGGAAAAATCAAAGAAATCAAAGAAGGATATTTGTCATTGGTGATCCAT
GAGATTTCAAAAATGGTAATTAAATATAATGCAATTATCGCAATGGAAGACCTGTCCTAT
GGTTTTAAGAAGGGTCGTTTCAAGGTAGAACGCCAAGTGTATCAAAAGTTCGAGACGATG
CTGATCAATAAGCTGAATTATCTTGTGTTTAAGGACATTAGCATCACGGAAAATGGAGGG
CTGTTGAAAGGCTATCAACTGACGTATATCCCTGACAAGCTGAAAAATGTTGGCCATCAG
TGCGGGTGCATTTTCTACGTCCCCGCGGCGTATACAAGCAAGATCGATCCTACTACGGGA
TTCGTAAATATTTTTAAATTCAAAGACTTAACCGTGGACGCCAAGCGCGAATTCATTAAG
AAGTTTGATAGCATTCGCTACGATTCAGAAAAAAATCTTTTCTGTTTTACGTTCGATTAC
AACAATTTTATCACCCAGAACACAGTGATGAGCAAGTCATCCTGGTCTGTCTATACCTAC

-continued

GGTGTCCGTATCAAACGCCGCTTCGTCAACGGACGCTTCTCTAATGAATCTGATACCATT

GACATCACCAAGGACATGGAAAAGACACTTGAGATGACAGATATTAACTGGCGTGACGGA

CATGACCTGCGTCAGGACATCATCGATTATGAGATTGTTCAGCATATCTTCGAGATCTTC

CGCCTGACAGTACAAATGCGCAATTCACTGTCAGAACTTGAAGACCGCGACTATGACCGC

CTGATCTCTCCAGTATTAAATGAGAACAATATCTTTTATGACAGTGCTAAGGCCGGCGAT

GCCCTTCCGAAAGATGCTGATGCTAACGGAGCTTATTGTATTGCATTAAAGGGTCTTTAT

GAGATCAAGCAAATTACCGAGAATTGGAAGGAGGATGGCAAATTCTCGCGCGACAAACTG

AAAATCAGTAACAAGGACTGGTTCGATTTTATTCAGAATAAACGTTACCTGAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 74

AGCCCAGCGGCTAAAAAAAAGAAACTGGATGGCAGCGTGGATATGAATAACGGAACGAAC

AACTTCCAGAACTTCATCGGCATCAGTTCTTTACAAAAAACCCTGCGTAACGCCCTTATT

CCGACTGAGACAACACAACAGTTCATCGTTAAAAACGGAATTATCAAAGAGGACGAGTTG

CGCGGCGAGAATCGCCAAATTTTGAAAGATATTATGGACGACTATTATCGTGGTTTTATT

TCAGAAACACTGAGTTCGATTGACGATATCGATTGGACGAGCCTGTTTGAGAAAATGGAA

ATCCAGTTGAAAAATGGCGATAATAAAGACACTTTAATCAAAGAACAAACCGAGTATCGT

AAAGCGATCCATAAAAAGTTCGCTAATGACGATCGTTTTAAGAATATGTTCAGTGCGAAA

CTGATTTCAGACATTTTGCCCGAGTTCGTGATCCATAATAACAACTATTCCGCCTCGGAA

AAGGAAGAAAAAACCCAGGTGATTAAGCTGTTCAGTCGCTTCGCAACATCTTTCAAGGAT

TATTTCAAGAATCGCGCGAATTGCTTCAGTGCGGACGATATTTCTAGTTCAAGCTGCCAT

CGTATCGTTAATGATAACGCGGAGATTTTTTTAGCAATGCTCTGGTGTACCGCCGCATT

GTTAAGTCACTGTCCAACGATGATATTAACAAGATCTCAGGAGACATGAAAGACTCGCTT

AAAGAGATGAGTCTGGAAGAGATCTATTCTTATGAGAAGTATGGCGAGTTTATTACCCAA

GAAGGAATCTCATTCTACAATGATATTTGTGGAAAGGTGAACAGCTTTATGAATCTTTAC

TGCCAAAAAAACAAGGAGAATAAGAATCTTTACAAACTTCAGAAGTTACATAAACAGATT

TTGTGTATTGCGGATACGTCTTATGAAGTCCCCTACAAATTTGAATCGGATGAAGAGGTA

TACCAAAGTGTGAACGGATTCTTGGACAATATTTCTTCTAAACATATTGTTGAACGCTTA

CGTAAGATCGGGGATAACTACAATGGCTACAATCTTGACAAAATCTACATTGTTAGCAAA

TTCTACGAGAGTGTCAGCCAAAAGACGTACCGCGATTGGGAAACAATTAATACTGCGCTT

GAGATTCACTATAATAACATTTTACCAGGCAACGGCAAGTCCAAGGCGGATAAAGTTAAA

AAAGCTGTTAAAAACGATTTGCAAAAATCTATCACAGAAATTAACGAGTTAGTTAGTAAC

TACAAACTGTGCTCCGATGACAACATTAAGGCTGAGACGTATATCCATGAGATCTCTCAC

ATCTTAAACAATTTTGAAGCTCAAGAACTTAAGTACAATCCGGAAATCCACCTGGTGGAA

TCCGAGCTGAAGGCTAGCGAACTGAAGAACGTATTGGACGTGATCATGAACGCGTTCCAC

TGGTGTTCTGTCTTTATGACGGAAGAGCTTGTCGACAAAGATAATAACTTTTACGCGGAA

CTTGAGGAAATTTACGATGAGATTTACCCAGTTATTTCATTGTATAACCTTGTCCGTAAT

TACGTGACCCAAAAGCCTTATAGTACGAAAAAAAATCAAATTAAATTTTGGAATCCCAACA

CTGGCTGACGGTTGGAGCAAATCTAAGGAGTATTCTAATAACGCAATCATCTTAATGCGT

GACAACCTGTATTATTTGGGTATCTTCAATGCCAAAAATAAGCCTGACAAAAAGATTATC

-continued

GAAGGAAATACTTCGGAGAATAAGGGGGATTACAAAAAAATGATTTACAATTTGCTGCCC

GGGCCGAACAAGATGATCCCCAAAGTGTTCTTATCCTCGAAGACTGGTGTAGAAACATAC

AAGCCAAGCGCATACATTCTGGAGGGTTACAAGCAAAACAAACACATCAAATCTTCAAAA

GACTTTGACATTACATTTTGCCATGATCTTATTGACTACTTCAAAAACTGCATTGCTATT

CACCCCGAGTGGAAGAACTTTGGGTTTGACTTCAGCGACACGTCTACGTATGAGGACATC

TCCGGGTTCTACCGTGAAGTTGAGTTACAAGGGTATAAGATTGACTGGACGTATATTTCA

GAGAAAGATATCGATCTTTTGCAGGAAAAGGGCCAGTTATATTTATTCCAGATTTACAAC

AAGGACTTTAGTAAGAAGTCAACAGGAAATGACAACTTGCATACGATGTATTTGAAAAAT

CTTTTTTCTGAGGAAAATCTTAAGGACATCGTACTGAAATTGAATGGCGAGGCTGAAATC

TTCTTCCGTAAATCCTCCATTAAGAATCCCATTATCCACAAAAAGGGGTCTATCCTGGTG

AATCGTACCTACGAGGCAGAGGAGAAGGATCAATTCGGAAATATTCAGATTGTTCGTAAG

AACATCCCCGAGAACATTTATCAAGAATTGTATAAGTACTTTAATGACAAATCTGACAAA

GAGTTATCCGACGAAGCTGCGAAACTGAAAAACGTTGTTGGTCACCACGAGGCCGCCACT

AATATCGTAAAAGACTACCGTTATACCTATGACAAGTACTTTTTGCACATGCCGATCACT

ATCAACTTCAAGGCGAATAAGACGGGCTTCATTAACGATCGTATCCTGCAATACATCGCC

AAGGAGAAGGACCTTCACGTCATTGGGATTGACCGTGGTGAGCGTAACCTGATTTATGTA

AGCGTCATTGATACCTGCGGTAATATCGTCGAACAGAAAAGTTTCAACATTGTAAATGGA

TATGACTATCAGATCAAACTTAAGCAGCAGGAGGGTGCACGCCAGATTGCCCGCAAGGAA

TGGAAGGAGATTGGGAAGATTAAGGAAATTAAAGAAGGTTACTTATCACTGGTTATTCAC

GAGATCAGTAAAATGGTAATCAAATATAACGCGATCATTGCCATGGAGGATCTGAGCTAT

GGCTTTAAAAAGGGCCGTTTCAAAGTCGAGCGCCAGGTATATCAAAAGTTTGAAACAATG

CTGATTAACAAATTAAACTATCTGGTTTTCAAAGATATTTCGATCACTGAAAATGGCGGG

CTGTTGAAGGGATACCAACTTACATACATCCCTGACAAACTGAAAAATGTCGGTCACCAA

TGTGGATGTATCTTTTATGTACCAGCAGCGTATACGAGCAAAATCGATCCAACTACGGGT

TTTGTGAACATCTTTAAGTTCAAGGATTTGACAGTAGATGCCAAACGCGAGTTCATTAAA

AAATTTGATTCAATTCGCTACGATTCAGAGAAAAATCTTTTTTGTTTCACGTTCGATTAC

AATAATTTCATTACGCAGAACACAGTAATGTCAAAGTCAAGCTGGTCGGTCTACACGTAT

GGAGTCCGTATTAAACGTCGTTTTGTAAACGGCCGTTTCTCAAATGAATCAGATACAATT

GATATTACGAAGGATATGGAGAAGACATTAGAGATGACTGACATTAACTGGCGCGACGGA

CATGATCTTCGTCAGGACATTATTGATTATGAGATTGTACAGCATATCTTTGAGATCTTC

CGCCTGACCGTTCAGATGCGCAATTCGTTGTCCGAGTTAGAAGACCGCGATTACGACCGT

TTAATCAGTCCCGTCTTAAACGAAAATAACATCTTCTACGATTCAGCCAAGGCAGGCGAT

GCCTTGCCAAAGGATGCTGACGCAAATGGCGCATACTGTATTGCGTTGAAAGGCCTTTAT

GAAATCAAGCAAATTACCGAAAACTGGAAAGAAGACGGAAAATTCTCCCGTGATAAGTTG

AAAATCTCTAATAAGGATTGGTTCGATTTCATCCAAAATAAACGCTATTTGAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 75
AGCCCAGCGGCTAAAAAAAAGAAACTGGATGGCAGCGTGGATATGAACAACGGAACTAAT

AATTTCCAAAATTTTATAGGCATCTCTTCTTTACAGAAGACTCTTCGTAACGCCCTAATC

-continued

CCGACTGAGACCACACAACAATTCATAGTGAAAAATGGGATCATTAAAGAAGACGAGCTG

CGTGGGGAGAACAGGCAGATCCTAAAAGACATAATGGACGATTATTATAGAGGGTTCATC

TCAGAGACATTATCTAGCATCGACGACATTGACTGGACCTCCCTGTTTGAAAAAATGGAA

ATCCAGCTGAAGAATGGTGACAATAAAGACACATTAATAAAAGAACAAACAGAGTACAGG

AAAGCCATCCACAAGAAGTTCGCAAACGATGACAGATTCAAAAATATGTTCAGTGCGAAG

CTAATATCCGACATCTTACCAGAGTTTGTAATACACAATAACAATTACAGCGCGAGCGAA

AAGGAAGAGAAAACGCAAGTAATTAAGCTTTTTAGTAGGTTCGCTACCTCTTTCAAAGAT

TACTTCAAAAATCGTGCTAACTGCTTCTCAGCCGACGACATATCTTCAAGTTCCTGTCAC

CGTATCGTGAATGATAACGCTGAGATATTCTTCTCAAACGCCCTTGTATACCGTAGGATC

GTAAAGTCCTTATCTAACGATGATATAAACAAGATCAGTGGAGACATGAAAGACAGCCTT

AAAGAGATGTCTCTAGAAGAAATTTACTCCTATGAAAAGTATGGGGAGTTTATAACACAG

GAGGGGATCAGCTTCTACAACGACATCTGCGGAAAGGTGAACAGTTTCATGAATCTTTAC

TGCCAGAAGAATAAAGAGAACAAAAATCTTTATAAGCTTCAAAAGTTGCACAAACAAATA

CTGTGCATTGCCGATACATCATATGAGGTCCCCTATAAGTTCGAATCTGATGAGGAAGTT

TATCAATCTGTTAACGGCTTTCTAGACAATATCAGCTCAAAACACATCGTAGAAAGACTG

AGGAAAATAGGTGATAATTATAATGGATACAACTTGGATAAAATATATATAGTCTCTAAA

TTTTACGAGTCAGTATCCCAGAAAACGTATAGGGATTGGGAGACCATCAACACGGCGTTA

GAGATTCATTACAATAACATCTTACCGGGAAACGGAAAAAGTAAGGCGGACAAAGTAAAG

AAAGCCGTTAAAAATGACTTACAAAAGAGTATAACAGAAATAAACGAACTAGTAAGCAAC

TACAAGCTTTGTTCCGATGATAATATCAAGGCCGAGACATATATCCATGAGATCTCCCAC

ATTCTAAACAATTTCGAAGCGCAAGAACTTAAATATAATCCCGAAATCCACCTGGTGGAA

AGTGAACTAAAGGCTAGTGAGTTAAAGAACGTTCTTGATGTTATCATGAACGCCTTCCAT

TGGTGCTCTGTTTTTATGACCGAGGAGTTGGTTGATAAAGATAATAATTTCTACGCTGAA

TTAGAGGAGATATACGACGAAATCTACCCAGTGATTTCACTATACAACTTGGTCAGGAAC

TATGTTACACAAAAGCCGTACAGCACTAAGAAAATTAAGCTAAATTTCGGTATCCCCACG

TTAGCCGACGGGTGGAGCAAGTCCAAAGAATATTCCAACAATGCGATTATTTTAATGCGT

GACAATCTTTATTACCTTGGCATCTTCAATGCCAAAAACAAACCTGACAAAAAGATTATA

GAAGGTAATACGTCCGAGAACAAAGGCGATTACAAGAAGATGATTTATAACCTACTGCCC

GGACCAAACAAAATGATCCCCAAAGTTTTTCTTAGTTCTAAAACCGGCGTAGAGACGTAT

AAACCTTCTGCCTATATCTTAGAGGGATATAAGCAGAACAAACATATCAAATCTTCCAAG

GACTTTGATATTACATTCTGCCACGATTTAATTGACTACTTCAAAAATTGCATAGCGATA

CATCCGGAGTGGAAGAACTTTGGCTTCGACTTCAGTGATACATCCACCTATGAGGATATA

TCAGGCTTCTATCGTGAGGTCGAATTGCAAGGGTACAAAATCGATTGGACGTATATATCC

GAGAAAGACATAGACCTTCTTCAAGAAAAGGGGCAGTTATATTTATTCCAAATATACAAC

AAGGACTTCAGTAAGAAGTCAACAGGTAATGACAACTTACACACCATGTACTTGAAAAAT

TTATTTTCTGAAGAAAACCTAAAGGACATTGTACTAAAACTGAACGGGGAGGCAGAAATT

TTTTTTAGAAAGAGCAGCATAAAAAACCCAATAATTCATAAGAAAGGAAGCATTTTAGTT

AATAGGACGTACGAGGCAGAGGAAAAGGACCAGTTTGGCAATATCCAGATCGTAAGGAAA

AATATTCCTGAAAACATATATCAGGAACTATATAAATACTTTAACGACAAATCCGACAAA

GAATTATCCGACGAGGCTGCAAAGCTGAAGAACGTCGTAGGGCACCATGAGGCAGCGACT

AATATTGTGAAAGACTATAGGTATACATACGACAAATACTTTCTGCACATGCCCATCACG

ATTAACTTCAAGGCGAACAAGACGGGATTCATTAACGACCGTATATTACAATATATTGCT

AAGGAGAAAGATCTGCATGTAATAGGTATCGACAGAGGCGAACGTAATTTAATCTACGTG

TCCGTCATCGACACGTGCGGGAACATCGTAGAGCAAAAGAGTTTTAATATAGTAAATGGC

TATGATTACCAAATTAAGCTAAAGCAGCAAGAAGGAGCAAGACAGATAGCTAGGAAAGAA

TGGAAGGAGATAGGAAAAATAAAGGAGATCAAGGAGGGGTATCTTAGCCTAGTAATTCAT

GAAATATCTAAGATGGTTATCAAATACAACGCTATCATAGCGATGGAAGACTTATCTTAT

GGTTTCAAGAAAGGAAGGTTCAAAGTAGAGCGTCAAGTTTATCAAAAGTTCGAAACGATG

TTGATTAATAAACTAAACTATTTGGTATTTAAAGATATATCTATCACCGAGAATGGTGGT

CTACTAAAGGGTTACCAGCTTACATACATACCGGACAAACTTAAAAACGTCGGACATCAG

TGTGGATGCATTTTCTACGTTCCAGCTGCATATACCAGCAAGATCGACCCAACGACTGGG

TTCGTAAATATTTTTAAATTCAAGGATTTGACTGTCGACGCCAAAAGAGAGTTCATAAAA

AAGTTCGATTCAATTAGGTACGACAGCGAAAAGAATTTGTTCTGCTTTACTTTTGACTAT

AACAATTTCATTACTCAGAACACTGTAATGTCTAAGTCCTCTTGGTCAGTCTATACTTAT

GGCGTTCGTATCAAACGTAGATTTGTTAACGGTAGATTCTCAAATGAAAGTGATACAATA

GATATCACGAAAGATATGGAGAAAACATTAGAAATGACAGACATAAACTGGAGAGACGGA

CATGACTTGAGACAGGACATTATTGACTACGAGATCGTGCAGCACATCTTTGAGATCTTT

CGTTTGACCGTACAAATGCGTAACAGTTTATCTGAGCTTGAGGACAGGGACTACGATAGA

TTGATATCACCTGTATTAAATGAGAATAACATCTTCTATGATTCCGCAAAAGCAGGCGAC

GCTCTACCCAAAGACGCTGATGCGAACGGTGCTTATTGCATAGCTTTAAAGGGTTTGTAT

GAGATCAAACAGATAACAGAAAATTGGAAGGAAGATGGTAAGTTCTCCCGTGACAAGCTT

AAAATATCAAATAAGGACTGGTTCGATTTTATACAGAATAAGCGTTATTAAAACGTCCGG

CAGCGACCAAAAAAGCCGGCCAGGCGAAGAAAAAAAAAGCGTCAGGTAGCGGCGCAGGCA

GCCCGAAAAAGAAACGTAAAGTCGAGGATCCGAAAAAGAAACGTAAGGTTATTCCGGGCT

AA

SEQ ID NO: 76
AGCCCAGCGGCTAAAAAAAAGAAACTGGATGGCAGCGTGGATATGAACAATGGAACTAAT

AACTTCCAGAATTTCATTGGTATCTCCTCTTTACAAAAAACTCTAAGAAACGCCCTAATT

CCGACTGAAACTACACAGCAATTCATCGTCAAAAACGGGATCATTAAGGAGGATGAGTTG

AGGGGTGAAAATCGTCAAATTCTTAAAGACATCATGGACGACTACTACAGGGGGTTCATC

AGCGAGACGTTATCTAGTATAGACGATATAGACTGGACTTCACTGTTCGAGAAGATGGAA

ATCCAATTAAAAAATGGGGACAATAAAGATACACTTATAAAGGAACAGACAGAGTATAGA

AAGGCAATACACAAAAAGTTTGCCAACGACGATCGTTTCAAGAACATGTTTAGTGCTAAA

TTGATTTCAGATATTCTGCCGGAATTTGTTATTCACAACAATAATTATAGCGCCAGTGAG

AAAGAAGAAAAAACGCAGGTTATCAAACTGTTCAGTCGTTTCGCTACATCTTTTAAGGAT

TACTTTAAAAACCGTGCAAATTGTTTTTCAGCCGACGATATTAGTAGCAGCTCTTGTCAC

CGTATTGTTAATGATAATGCGGAGATTTTCTTTTCAAACGCATTGGTCTACAGGAGGATA

GTCAAGTCCCTTTCAAATGACGACATTAATAAGATCTCAGGTGACATGAAAGATTCCTTA

AAGGAAATGTCCCTGGAAGAGATCTATTCCTATGAAAAGTACGGTGAGTTCATTACTCAA

GAGGGTATAAGCTTTTACAATGACATATGTGGTAAGGTTAATAGCTTTATGAACCTGTAT

TGCCAGAAGAACAAAGAAAATAAGAATCTGTATAAGTTGCAAAAGCTACACAAACAAATT

TTGTGCATTGCCGATACATCATACGAGGTGCCATACAAATTCGAGAGCGATGAGGAGGTT

-continued

TATCAGAGCGTGAATGGATTCCTGGACAATATTAGTAGTAAGCATATCGTGGAAAGGCTT

AGAAAGATAGGTGACAATTACAATGGCTACAATCTGGATAAAATCTACATCGTCTCAAAA

TTCTATGAAAGTGTATCCCAGAAGACGTACCGTGATTGGGAAACTATCAACACCGCTCTG

GAGATACATTACAACAATATACTTCCCGGAAACGGCAAGTCAAAAGCCGACAAAGTCAAA

AAAGCGGTCAAGAACGATTTACAAAAGTCTATCACTGAAATTAATGAATTAGTTAGTAAT

TACAAACTGTGTAGTGATGATAATATTAAGGCAGAGACTTACATACACGAAATTTCACAC

ATTTTAAACAACTTCGAGGCACAGGAACTTAAATATAATCCTGAAATTCACCTGGTTGAA

AGTGAATTGAAAGCCAGCGAGCTAAAGAACGTTTTGGACGTAATCATGAACGCATTCCAC

TGGTGCTCTGTCTTTATGACAGAGGAACTAGTGGATAAGGACAATAATTTTTATGCGGAG

CTGGAGGAAATATACGATGAGATATATCCCGTAATATCATTATATAATCTGGTAAGAAAC

TATGTGACTCAAAAGCCGTATAGCACCAAGAAAATTAAACTTAATTTCGGCATACCCACT

TTAGCGGACGGCTGGTCAAAATCCAAAGAGTATAGTAATAATGCCATCATCCTGATGCGT

GACAACCTGTACTATTTAGGTATATTTAACGCCAAAAATAAACCCGACAAAAAGATTATA

GAGGGCAACACCTCAGAGAACAAAGGTGATTATAAGAAGATGATTTACAACCTTTTACCC

GGTCCTAATAAGATGATTCCCAAAGTCTTTCTATCTAGCAAAACTGGTGTTGAAACATAC

AAACCCTCAGCTTATATTTTAGAAGGGTATAAGCAGAATAAGCATATTAAAAGCTCCAAA

GATTTCGATATTACCTTTTGCCATGACTTGATAGACTATTTCAAAAATTGTATTGCCATT

CACCCTGAATGGAAAAACTTCGGATTTGACTTCTCTGACACATCCACCTACGAAGACATT

TCAGGTTTTTACAGGGAAGTCGAGCTACAGGGTTATAAAATTGATTGGACATACATCAGC

GAGAAAGATATTGACCTACTTCAAGAAAAAGGGCAGCTATACCTGTTCCAGATATACAAT

AAAGACTTCAGTAAAAAAAGCACCGGGAACGATAATCTTCACACAATGTACTTAAAAAAT

TTATTTAGTGAAGAGAATCTGAAGGATATAGTGCTGAAGTTAAACGGGGAGGCAGAGATA

TTTTTTAGAAAATCTAGTATTAAGAATCCGATCATCCACAAGAAGGGTTCTATCCTTGTT

AATAGGACTTATGAGGCAGAAGAAAAAGACCAATTCGGCAACATACAAATTGTCCGTAAA

AATATCCCTGAGAACATTTATCAGGAACTATACAAGTACTTCAATGATAAAAGCGACAAG

GAGCTGAGCGACGAGGCTGCTAAGTTAAAGAATGTGGTGGGCCACCATGAGGCAGCAACG

AATATTGTGAAGGACTATCGTTATACCTACGATAAATACTTTCTTCATATGCCGATCACC

ATTAATTTCAAGGCAAACAAAACTGGCTTCATTAACGATCGTATCTTACAATATATCGCA

AAAGAGAAAGACCTTCACGTTATCGGGATCGATAGAGGCGAGCGTAACCTAATTTATGTT

TCTGTGATAGACACCTGTGGGAACATAGTCGAACAGAAATCATTTAATATTGTTAACGGC

TACGATTATCAGATAAAGTTGAAGCAACAAGAGGGTGCACGTCAAATAGCAAGGAAAGAA

TGGAAAGAAATAGGCAAGATTAAAGAAATAAAAGAAGGTTATTTATCCCTTGTAATACAC

GAAATTAGCAAAATGGTGATTAAATATAATGCGATCATTGCCATGGAGGATCTTTCTTAC

GGCTTCAAAAAGGGGAGATTCAAAGTCGAGAGGCAGGTGTATCAGAAGTTTGAGACCATG

CTAATCAATAAACTAAATTATCTAGTATTCAAAGACATAAGCATCACCGAAAATGGCGGC

TTGTTGAAGGGTTATCAATTGACCTACATCCCAGATAAACTAAAAAACGTAGGGCATCAA

TGCGGATGTATATTTTACGTTCCAGCCGCATACACTTCCAAAATCGATCCAACTACGGGT

TTTGTGAACATCTTCAAATTCAAAGACTTGACTGTCGATGCTAAGAGGGAGTTTATCAAG

AAATTTGACTCCATTAGATACGACAGTGAGAAGAATCTGTTCTGTTTTACCTTTGATTAT

AACAACTTTATAACTCAAAACACAGTCATGAGTAAGTCATCTTGGTCAGTGTATACGTAT

-continued

GGTGTGAGGATTAAAAGGAGGTTTGTTAACGGGAGATTTTCCAATGAAAGTGATACAATA

GATATAACCAAGGACATGGAAAAGACTCTTGAAATGACCGACATTAACTGGAGAGATGGC

CACGACTTACGTCAAGATATAATCGATTACGAGATAGTGCAACATATCTTTGAGATATTT

AGGCTTACTGTCCAAATGCGTAACTCATTAAGTGAGTTGGAGGACAGGGATTACGATAGG

CTAATAAGTCCTGTTCTTAACGAAAACAATATATTCTACGATTCAGCAAAGGCGGGAGAC

GCCCTGCCCAAGGACGCGGATGCTAACGGCGCATACTGTATTGCCCTGAAAGGCTTGTAC

GAGATAAAACAGATCACGGAGAACTGGAAAGAAGATGGAAAATTCAGTCGTGACAAGTTA

AAAATTAGTAACAAAGACTGGTTCGACTTTATTCAGAACAAGAGATATCTGAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 77
AGCCCAGCGGCTAAAAAAAAGAAACTGGATGGCAGCGTGGATATGAACAACGGAACCAAT

AACTTTCAAAACTTTATAGGCATCTCCAGTCTACAGAAGACACTACGTAACGCTTTGATA

CCAACTGAGACCACGCAGCAGTTTATCGTCAAGAACGGTATTATAAAGGAAGACGAGCTA

AGGGGGGAAAACCGTCAGATCTTAAAGGACATCATGGATGACTACTACAGAGGCTTCATA

AGTGAGACTTTGTCTAGTATAGACGACATCGACTGGACCAGTTTATTTGAGAAGATGGAA

ATTCAGTTAAAGAACGGGGACAATAAAGACACACTAATTAAAGAGCAGACCGAATACAGA

AAAGCTATACACAAAAAGTTTGCCAACGATGATAGATTCAAAAATATGTTTTCAGCAAAA

TTGATTTCCGACATATTGCCAGAATTCGTAATCCATAATAACAATTATTCTGCAAGTGAG

AAGGAAGAGAAGACCCAAGTAATCAAGCTGTTTTCCCGTTTTGCTACGAGTTTCAAAGAT

TATTTCAAGAATAGGGCTAATTGTTTCTCCGCGGACGACATAAGTAGCAGTTCCTGTCAC

AGGATTGTGAACGATAATGCTGAGATATTTTTTTCCAATGCCCTAGTGTATAGGAGAATA

GTTAAAAGCTTAAGCAACGACGATATCAATAAAATTTCAGGGGACATGAAGGACAGCTTA

AAGGAAATGAGTTTGGAGGAGATTTACAGTTATGAAAAATACGGAGAGTTTATAACTCAG

GAAGGCATCTCTTTCTATAATGATATCTGTGGGAAGGTAAACTCCTTCATGAATTTATAT

TGCCAGAAGAATAAGGAAAACAAAAATCTTTACAAGCTTCAAAAGTTACATAAGCAGATC

TTATGTATTGCCGACACGAGTTATGAAGTGCCTTATAAATTCGAGAGTGATGAGGAAGTG

TATCAGTCTGTTAACGGATTCCTAGATAATATAAGTTCCAAACATATAGTCGAGAGGCTG

AGGAAGATTGGCGATAACTATAATGGATATAATCTTGACAAAATCTATATAGTCTCTAAA

TTTTATGAAAGCGTCAGCCAGAAGACATATAGAGATTGGGAAACTATAAACACAGCCCTT

GAAATACATTACAATAACATCCTACCCGGCAATGGTAAGTCTAAGGCAGACAAAGTTAAA

AAAGCAGTAAAGAATGACTTACAGAAGTCAATCACGGAGATAAATGAGTTGGTCAGTAAC

TACAAATTATGCTCCGACGATAATATTAAGGCCGAAACATATATACACGAGATAAGTCAT

ATATTAAACAATTTCGAAGCCCAGGAGTTAAAATATAACCCTGAAATTCATCTGGTCGAA

AGTGAGTTAAAGGCCAGTGAGTTAAAGAATGTACTTGACGTAATTATGAATGCTTTTCAT

TGGTGCTCCGTGTTCATGACCGAGGAGTTAGTAGATAAAGACAATAACTTTTACGCCGAA

CTTGAAGAGATATACGACGAGATTTATCCGGTAATCAGCTTGTACAACTTAGTTAGAAAT

TATGTAACACAGAAGCCTTACTCTACTAAAAAAATAAAACTGAACTTTGGTATCCCAACT

CTTGCAGATGGTTGGAGTAAAAGCAAGGAATATAGCAACAATGCGATCATCTTGATGAGA

GACAACTTGTACTATTTGGGAATCTTCAACGCGAAAAATAAACCCGACAAAAAAATCATC

-continued

GAAGGGAATACCTCTGAGAATAAAGGTGACTATAAGAAAATGATTTACAATCTACTTCCT

GGTCCTAATAAAATGATCCCGAAAGTGTTTCTTAGTTCTAAGACTGGTGTCGAGACGTAC

AAACCTAGCGCGTACATCTTAGAAGGGTACAAGCAGAATAAACACATCAAATCAAGCAAA

GACTTCGATATTACTTTTTGCCATGACTTGATAGACTACTTTAAAAACTGCATAGCAATC

CACCCGGAGTGGAAAAACTTTGGCTTTGATTTCTCTGACACCTCTACATATGAGGACATA

TCTGGTTTTTACCGTGAGGTTGAATTGCAGGGATACAAAATTGACTGGACTTACATATCT

GAAAAAGATATCGATCTATTGCAGGAGAAAGGCCAGCTTTACCTTTTCCAGATCTATAAT

AAGGACTTCTCTAAGAAGTCTACAGGGAATGATAATTTGCACACTATGTACTTAAAAAAT

CTGTTTTCCGAGGAAAACTTGAAAGACATTGTTTTAAAGTTGAACGGAGAAGCTGAAATA

TTTTTCAGAAAGAGCTCCATAAAAAACCCGATCATTCATAAGAAGGGATCTATCCTGGTT

AACAGAACGTACGAAGCGGAAGAAAAAGACCAATTCGGAAACATTCAAATTGTTAGAAAG

AATATCCCTGAGAACATCTACCAGGAGTTATATAAGTATTTTAATGATAAGTCAGATAAG

GAACTATCTGACGAAGCGGCGAAGCTTAAAAATGTTGTAGGACACCATGAGGCTGCTACA

AATATAGTCAAGGACTACCGTTATACCTACGATAAGTACTTTCTACACATGCCCATTACC

ATCAATTTTAAAGCTAATAAAACGGGTTTTATCAACGATCGTATCCTACAATATATTGCG

AAAGAGAAGGATTTGCATGTCATTGGCATTGATAGAGGTGAGAGGAACCTAATATACGTA

TCCGTGATTGATACGTGCGGGAACATAGTTGAACAGAAATCATTTAATATAGTTAATGGG

TACGACTATCAGATTAAGCTAAAGCAACAAGAAGGCGCCAGGCAAATTGCCCGTAAAGAA

TGGAAAGAGATCGGGAAGATCAAGGAAATAAAAGAAGGATACCTTTCCCTGGTCATCCAT

GAAATTAGCAAAATGGTGATTAAGTACAATGCCATAATCGCGATGGAGGACTTAAGCTAC

GGGTTCAAAAAGGGGAGGTTTAAGGTGGAGAGGCAAGTGTACCAGAAATTTGAGACCATG

CTAATCAACAAACTGAACTACCTAGTTTTTAAGGACATTTCAATTACAGAGAATGGAGGA

CTTTTAAAGGGTTACCAACTAACGTATATACCAGATAAGTTGAAAAATGTCGGTCACCAG

TGTGGCTGCATCTTTTACGTTCCCGCCGCTTATACATCTAAAATTGATCCAACCACAGGC

TTTGTAAATATCTTTAAATTCAAAGATTTAACTGTGGATGCAAAAAGAGAGTTTATCAAG

AAATTCGATAGCATTCGTTATGATAGCGAGAAGAACCTGTTCTGCTTTACTTTCGACTAT

AACAACTTTATAACTCAAAACACCGTGATGTCAAAAAGCTCATGGTCAGTCTACACCTAT

GGTGTAAGGATTAAAAGGCGTTTCGTGAATGGGAGATTCTCCAATGAAAGTGACACGATC

GACATAACAAAGGACATGGAGAAGACACTAGAGATGACTGATATTAATTGGAGAGACGGA

CACGATCTGCGTCAAGATATAATTGATTATGAGATAGTACAGCACATATTTGAGATCTTC

CGTTTGACTGTCCAAATGCGTAATTCCCTTTCTGAGCTGGAAGATAGGGACTATGATAGA

TTAATATCCCCTGTACTAAATGAGAACAACATTTTCTATGATAGTGCAAAAGCCGGGGAT

GCATTGCCGAAAGACGCTGACGCTAATGGGGCGTACTGTATAGCTTTAAAGGGGCTTTAC

GAAATAAAGCAGATAACCGAAAACTGGAAGGAAGATGGCAAATTCTCAAGGGACAAACTT

AAGATCTCTAACAAGGATTGGTTCGATTTTATACAAAACAAACGTTATTTGAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 78
AGCCCAGCGGCTAAAAAAAAGAAACTGGATGGCAGCGTGGATATGAATAATGGTACAAAC

AACTTTCAGAATTTCATTGGGATCTCTAGCTTACAGAAGACCCTGAGGAATGCGTTGATT

CCAACTGAAACAACCCAGCAATTCATCGTGAAAAATGGGATAATCAAAGAGGATGAGTTA

AGGGGTGAAAACCGTCAAATATTGAAGGATATTATGGACGACTACTACCGTGGATTCATC

TCAGAGACGTTGAGCAGCATTGACGACATAGACTGGACTAGCCTTTTCGAGAAGATGGAA

ATTCAGTTAAAGAACGGAGATAACAAAGATACACTAATCAAGGAACAGACAGAATACAGA

AAAGCAATTCATAAGAAATTCGCTAATGACGATCGTTTTAAAAACATGTTCTCTGCAAAA

TTAATTAGCGACATTCTGCCGGAATTCGTTATACATAATAATAACTACAGTGCTTCTGAA

AAGGAAGAGAAAACTCAGGTAATAAAACTGTTCTCTCGTTTTGCCACATCCTTCAAAGAC

TACTTTAAAAATAGAGCGAACTGCTTTAGCGCCGACGATATTAGTTCTTCCTCATGCCAC

AGGATTGTCAACGATAATGCAGAGATATTCTTTTCTAACGCACTAGTCTACAGAAGGATT

GTAAAGTCTTTGTCAAATGATGACATAAACAAGATTAGTGGAGATATGAAAGACTCTCTA

AAGGAAATGAGCCTTGAGGAGATATACTCTTATGAAAAGTACGGTGAGTTTATTACCCAA

GAAGGCATTAGTTTCTATAATGACATTTGTGGAAAAGTTAACAGTTTTATGAATCTATAC

TGTCAAAAAAATAAGGAGAATAAAAATCTTTATAAGTTGCAAAAACTGCATAAGCAGATA

TTATGTATAGCAGACACGAGCTATGAGGTACCGTACAAGTTCGAGAGCGATGAGGAAGTC

TACCAATCTGTCAACGGATTTTTGGACAACATTTCTTCAAAACATATTGTGGAGAGGCTT

AGGAAAATAGGCGACAATTATAATGGATATAACTTAGATAAGATATATATTGTTTCCAAA

TTCTACGAATCTGTAAGCCAGAAGACATACAGAGATTGGGAAACGATAAACACAGCCCTT

GAAATTCACTATAACAACATACTACCTGGAAACGGCAAATCAAAGGCCGACAAAGTTAAG

AAGGCCGTAAAGAATGATTTACAGAAGAGCATAACGGAGATCAATGAGCTGGTGTCTAAC

TATAAATTGTGTAGCGATGACAACATAAAAGCCGAGACTTACATTCACGAAATTTCACAC

ATACTTAACAACTTTGAAGCTCAGGAATTAAAGTATAATCCCGAAATACACCTTGTGGAG

TCCGAACTAAAGGCTAGTGAGCTTAAGAACGTCCTAGACGTAATTATGAATGCCTTCCAC

TGGTGTAGTGTTTTTATGACCGAGGAACTTGTTGACAAAGATAATAATTTTTATGCAGAA

CTAGAAGAGATATACGATGAAATATACCCGGTGATCAGTTTGTACAATCTTGTCAGGAAC

TATGTGACACAAAAGCCCTATTCAACAAAGAAAATAAAACTTAATTTCGGAATTCCTACG

TTAGCTGATGGCTGGTCTAAATCCAAGGAATACAGCAACAACGCTATAATTCTGATGAGA

GATAACTTGTACTATCTAGGCATCTTCAATGCCAAAAATAAGCCTGATAAGAAGATTATA

GAGGGCAACACTTCAGAGAACAAGGGCGACTACAAGAAAATGATCTATAACCTATTGCCT

GGCCCAAACAAGATGATTCCGAAGGTCTTCCTATCATCCAAGACCGGCGTTGAGACATAC

AAGCCATCAGCGTATATTTTAGAGGGGTACAAACAAAACAAGCACATAAAGTCTAGTAAA

GACTTCGATATAACATTTTGTCATGACTTAATTGACTACTTTAAGAATTGCATCGCTATA

CACCCGGAATGGAAGAATTTCGGCTTCGACTTCTCTGATACATCTACCTACGAGGACATT

AGCGGGTTTTACCGTGAAGTCGAATTACAAGGGTATAAGATAGATTGGACGTACATCTCT

GAGAAAGACATAGACTTGCTTCAGGAAAAGGGCCAGTTGTATCTATTCCAAATATACAAT

AAGGATTTTTCCAAGAAATCTACGGGTAATGACAATCTTCACACAATGTATCTTAAGAAC

CTTTTCTCAGAAGAGAACCTGAAGGACATTGTCTTAAAACTAAATGGCGAAGCTGAGATT

TTTTTCAGGAAGTCTTCAATTAAGAACCCGATAATCCACAAGAAGGGGAGTATTCTTGTG

AATAGAACTTACGAGGCCGAAGAAAAAGACCAATTTGGTAACATCCAGATAGTCAGAAAG

AACATTCCAGAGAACATCTACCAAGAGCTATACAAATATTTCAACGACAAGTCCGATAAG

GAACTGTCCGATGAGGCAGCCAAGTTGAAGAATGTCGTGGGTCATCATGAAGCTGCTACT

AACATTGTCAAGGACTATCGTTATACTTACGACAAGTATTTCCTACACATGCCGATAACA

-continued

ATTAATTTCAAGGCTAACAAAACAGGCTTTATCAACGATCGTATCTTGCAGTACATAGCT

AAGGAAAAGGATTTGCATGTGATTGGCATTGATAGAGGGGAGCGTAACTTGATATATGTG

TCTGTCATAGACACGTGTGGCAACATCGTCGAACAGAAATCATTCAACATAGTAAACGGC

TACGATTACCAAATTAAGCTGAAACAGCAAGAGGGTGCACGTCAAATTGCGCGTAAAGAG

TGGAAAGAAATTGGTAAAATCAAGGAAATTAAAGAAGGCTACTTGTCTCTTGTTATACAT

GAAATTTCCAAGATGGTTATAAAGTATAACGCGATAATTGCTATGGAAGACTTATCATAC

GGGTTTAAAAAGGGGAGGTTCAAGGTAGAGAGGCAGGTCTATCAAAAGTTCGAGACGATG

TTGATTAATAAACTAAACTATCTAGTGTTCAAAGATATCAGCATTACGGAGAACGGGGGG

CTACTGAAAGGATATCAACTAACGTACATTCCCGATAAGTTAAAGAACGTTGGTCATCAA

TGTGGTTGCATCTTCTACGTGCCTGCTGCCTATACGTCCAAAATAGATCCAACTACTGGA

TTTGTTAACATCTTTAAATTCAAAGATTTAACCGTAGACGCCAAAAGGGAATTTATAAAA

AAATTTGACAGCATCCGTTACGATAGCGAAAAGAATCTGTTCTGTTTTACTTTCGACTAC

AATAATTTCATCACGCAAAATACGGTAATGTCTAAGTCAAGTTGGAGCGTCTACACGTAT

GGAGTCAGGATCAAGAGGCGTTTCGTAAATGGAAGATTCTCTAATGAGTCAGATACTATA

GACATCACGAAAGATATGGAGAAAACCTTGGAGATGACGGATATTAACTGGCGTGATGGA

CACGATTTAAGACAGGACATTATTGACTATGAGATTGTGCAACACATCTTCGAAATATTC

CGTCTAACAGTCCAAATGAGGAATAGCCTAAGTGAATTGGAGGACCGTGATTACGATAGG

CTTATAAGTCCTGTCCTTAACGAAAACAATATTTTCTATGATAGTGCTAAGGCGGGGGAC

GCACTGCCTAAAGACGCAGATGCTAACGGGGCATACTGCATTGCGTTAAAGGGTCTGTAC

GAAATCAAGCAGATTACGGAAAACTGGAAAGAGGATGGCAAGTTTAGCAGAGATAAGTTG

AAGATAAGTAACAAAGATTGGTTTGACTTTATTCAGAATAAAAGGTATTTAAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 79
AGCCCAGCGGCTAAAAAAAAGAAACTGGATGGCAGCGTGGATATGAATAACGGCACTAAT

AATTTCCAGAATTTCATCGGCATTAGCAGCTTACAAAAGACGTTGAGGAATGCCTTAATA

CCCACAGAAACTACTCAACAATTTATAGTGAAGAATGGGATAATTAAGGAAGACGAGTTG

AGAGGTGAAAATAGGCAAATCTTGAAAGACATTATGGATGACTACTACAGGGGCTTCATT

AGTGAAACGTTGTCTTCAATAGATGACATTGATTGGACTTCTTTGTTTGAGAAGATGGAA

ATACAGTTAAAGAACGGCGACAATAAGGATACACTTATCAAAGAGCAAACAGAATATAGA

AAAGCAATTCACAAAAAGTTTGCTAACGATGATAGGTTCAAGAACATGTTTAGCGCTAAA

CTAATATCAGACATCCTTCCCGAGTTCGTTATTCATAACAATAACTATAGTGCAAGTGAA

AAAGAGGAGAAGACACAGGTGATTAAGCTGTTCTCCAGATTCGCGACTTCTTTCAAAGAT

TACTTCAAAAACAGAGCCAACTGTTTTTCAGCTGACGATATCTCTAGTAGTAGTTGTCAC

CGTATAGTGAACGATAACGCTGAGATCTTCTTTAGCAATGCATTAGTGTATAGAAGGATA

GTTAAGTCTCTAAGCAATGATGATATCAATAAAATTTCCGGAGACATGAAGGACTCCCTA

AAGGAAATGTCCTTAGAAGAGATCTACTCATATGAGAAATACGGGGAATTTATTACGCAG

GAAGGGATCTCCTTTTACAATGACATATGCGGGAAGGTCAACTCTTTCATGAACTTATAC

TGCCAAAAGAACAAGGAGAACAAGAATTTATATAAACTTCAGAAACTTCACAAACAAATA

CTGTGCATAGCCGATACCTCATATGAGGTTCCTTACAAATTTGAATCAGATGAAGAGGTA

-continued

TACCAATCCGTTAACGGCTTTCTTGACAATATTAGCTCAAAGCACATCGTGGAGAGGTTG

AGAAAGATTGGTGATAATTATAATGGCTACAATCTAGATAAGATATATATTGTTAGCAAG

TTCTACGAGTCTGTGTCCCAAAAAACATATAGGGATTGGGAGACAATTAATACTGCTCTA

GAAATCCATTACAACAACATCCTTCCTGGAAATGGCAAGAGTAAGGCCGACAAAGTCAAG

AAAGCAGTGAAAAATGATCTGCAAAAATCAATTACTGAGATAAACGAGCTAGTATCTAAT

TACAAGCTTTGTAGCGACGATAACATTAAGGCAGAAACGTACATACACGAGATTAGTCAC

ATCTTAAATAATTTTGAAGCCCAAGAACTGAAATATAACCCTGAGATACACCTTGTTGAA

TCCGAGTTAAAGGCGTCTGAACTAAAAAACGTGTTAGACGTTATTATGAATGCCTTCCAC

TGGTGTAGCGTCTTTATGACTGAGGAGTTGGTTGATAAGGATAATAACTTTTACGCTGAA

TTGGAAGAAATTTATGACGAAATCTATCCTGTTATTTCTCTATATAATTTGGTGAGAAAT

TACGTAACGCAAAAGCCCTATAGTACGAAAAAAATAAAACTAAATTTCGGGATCCCTACC

CTAGCCGACGGTTGGTCTAAATCCAAGGAGTACTCAAACAATGCAATAATATTGATGAGG

GACAACCTGTACTACCTAGGCATATTTAATGCCAAAAATAAGCCCGATAAAAAGATTATA

GAAGGGAACACGTCAGAAAATAAAGGAGACTATAAGAAAATGATCTACAACCTTTTGCCC

GGCCCCAATAAAATGATCCCGAAGGTCTTCCTAAGTAGCAAGACTGGCGTAGAGACCTAC

AAACCATCTGCATACATTTTGGAGGGGTACAAGCAAAACAAGCACATAAAGAGTAGTAAG

GATTTTGACATTACATTCTGCCATGACTTAATTGACTACTTTAAAAATTGCATCGCAATT

CACCCTGAATGGAAAAATTTTGGATTTGATTTCTCTGATACTTCAACATATGAGGATATT

TCAGGGTTCTACAGGGAGGTCGAACTACAGGGTTACAAAATAGACTGGACGTATATTTCT

GAGAAAGATATAGATTTGCTTCAGGAAAAGGGTCAGCTATATCTGTTCCAGATATATAAT

AAGGACTTCTCCAAAAAGAGTACCGGAAATGATAATCTGCACACAATGTACTTAAAAAAC

TTGTTCTCTGAGGAGAATCTAAAAGACATCGTACTAAAACTTAACGGGGAGGCCGAAATT

TTTTTTAGGAAGTCCAGCATCAAGAACCCGATTATTCATAAAAAAGGTAGCATTTTGGTG

AACCGTACTTATGAGGCGGAAGAAAAAGACCAATTCGGTAATATTCAAATCGTTAGAAAG

AACATCCCTGAGAACATTTATCAGGAACTATACAAATACTTTAACGACAAATCAGATAAG

GAGCTTTCTGATGAGGCAGCTAAATTGAAAAATGTAGTGGGACATCACGAAGCAGCCACT

AACATAGTGAAGGACTACAGATACACATACGATAAGTACTTCCTGCACATGCCTATTACA

ATTAACTTTAAAGCAAATAAAACAGGGTTTATTAACGACAGAATCTTACAGTATATTGCC

AAAGAAAAGGATCTGCATGTGATAGGAATAGACAGAGGAGAAAGAAACCTGATATACGTC

TCCGTGATTGATACATGTGGGAACATAGTAGAACAGAAGTCCTTTAACATTGTTAATGGG

TACGATTATCAAATTAAATTAAAACAACAAGAAGGAGCACGTCAAATAGCTAGGAAAGAA

TGGAAAGAGATAGGAAAAATTAAGGAAATTAAGGAGGGTTACCTGTCCCTTGTAATTCAT

GAAATATCCAAAATGGTAATTAAATATAACGCGATCATCGCGATGGAAGATCTAAGCTAC

GGGTTCAAAAAAGGCAGGTTTAAGGTGGAGAGGCAAGTTTACCAAAAGTTCGAGACAATG

TTGATTAATAAGTTAAACTACTTAGTTTTCAAAGATATCTCCATAACCGAGAATGGCGGG

CTTTTAAAAGGGTACCAACTAACATATATCCCGGATAAATTGAAGAACGTTGGACACCAG

TGTGGCTGCATATTTTATGTACCCGCTGCGTATACTTCTAAAATTGACCCGACCACCGGG

TTTGTAAACATATTCAAGTTTAAGGACCTAACAGTTGACGCCAAACGTGAGTTCATCAAG

AAGTTCGATAGTATAAGGTATGACTCTGAGAAGAACCTTTTCTGCTTCACGTTTGACTAT

AATAATTTCATCACCCAAAATACAGTTATGTCAAAAAGCTCTTGGTCAGTATATACGTAT

-continued

GGCGTAAGGATTAAGCGTAGGTTCGTGAACGGTAGATTTTCCAACGAGTCAGATACTATT

GATATTACCAAGGATATGGAGAAGACATTAGAAATGACAGATATAAATTGGAGGGATGGG

CACGATCTAAGGCAAGATATCATTGATTACGAAATTGTTCAGCACATATTCGAGATATTC

CGTCTTACAGTACAAATGCGTAACAGCTTGTCTGAGTTGGAAGATCGTGACTATGACAGG

TTGATATCACCGGTCTTGAACGAGAACAATATATTCTACGACAGCGCTAAGGCGGGAGAC

GCTCTGCCTAAAGACGCAGATGCCAATGGGGCGTACTGCATTGCCTTAAAAGGCTTATAC

GAGATTAAACAGATCACAGAGAACTGGAAAGAGGACGGCAAGTTTTCTAGAGATAAATTG

AAAATCTCAAACAAAGACTGGTTCGATTTCATCCAAAACAAAAGATACCTTAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 80
AGCCCAGCGGCTAAAAAAAAGAAACTGGATGGCAGCGTGGATATGAACAATGGAACTAAC

AACTTCCAGAACTTTATCGGCATCTCTTCCCTCCAAAAGACACTGAGAAATGCACTGATC

CCAACCGAAACGACTCAACAATTTATTGTTAAGAACGGCATCATAAAAGAAGACGAGCTT

CGCGGCGAGAACCGCCAGATACTTAAGGATATTATGGACGATTATTACCGAGGCTTTATC

AGCGAAACTCTTAGCTCTATTGATGATATCGACTGGACCTCCCTCTTCGAAAAAATGGAG

ATACAGCTCAAGAACGGCGATAATAAAGACACCTTGATAAAGGAACAGACTGAGTACAGG

AAAGCGATCCACAAGAAATTCGCGAACGACGACAGGTTTAAAAACATGTTCTCTGCAAAA

TTGATATCCGACATCTTGCCGGAATTTGTGATACACAACAATAACTATAGCGCTTCAGAG

AAAGAAGAGAAGACCCAAGTAATCAAGTTGTTCAGCCGCTTCGCAACGTCTTTTAAAGAT

TACTTTAAGAACCGGGCCAATTGTTTCTCCGCGGATGATATTAGCTCATCAAGTTGCCAT

CGAATTGTCAATGATAATGCGGAGATCTTCTTCAGCAATGCGCTGGTCTACAGACGAATC

GTAAAAAGTCTTTCAAATGACGACATCAATAAGATTAGTGGAGATATGAAGGATTCCCTT

AAGGAAATGAGTCTTGAAGAAATATACTCATACGAAAAGTACGGGGAATTTATTACCCAG

GAGGGGATCTCCTTCTATAACGACATCTGTGGAAAAGTAAACTCATTCATGAACCTGTAC

TGTCAGAAAAACAAAGAAAACAAAAATCTGTATAAACTCCAAAAATTGCACAAGCAAATA

TTGTGTATAGCGGACACATCATACGAGGTTCCATATAAGTTCGAAAGTGATGAAGAAGTC

TACCAATCAGTGAATGGGTTTCTGGACAACATTAGTTCCAAGCACATAGTTGAACGACTG

CGAAAGATTGGTGACAATTACAACGGCTATAATTTGGACAAGATTTATATAGTTAGCAAA

TTTTATGAATCCGTATCACAAAAGACTTATAGAGACTGGGAAACAATCAACACGGCACTT

GAGATCCATTATAACAATATTCTTCCAGGGAACGGCAAAAGCAAGGCTGATAAGGTAAAA

AAGGCCGTTAAGAATGATCTTCAAAAATCCATAACGGAGATCAACGAACTTGTAAGTAAC

TACAAATTGTGCTCTGACGACAATATAAAGGCTGAAACGTATATTCACGAGATTAGCCAT

ATCCTGAATAACTTTGAGGCCCAAGAACTCAAGTATAACCCGGAAATACATTTGGTAGAA

AGCGAGCTTAAAGCGAGTGAGCTGAAAAACGTCCTCGATGTGATCATGAATGCTTTCCAC

TGGTGTAGTGTCTTTATGACTGAGGAGTTGGTTGATAAAGACAATAATTTCTACGCTGAA

CTGGAAGAAATTTACGACGAAATCTATCCAGTGATCTCCCTCTATAACCTCGTTCGAAAC

TACGTGACGCAGAAACCTTATTCTACAAAGAAAATTAAGTTGAACTTCGGCATTCCTACA

CTTGCTGACGGATGGTCCAAATCCAAAGAGTACTCAAACAACGCAATCATCCTCATGCGG

GATAACCTTTATTATTTGGGCATTTTCAACGCCAAAAACAAACCTGATAAAAAGATAATT

-continued

GAAGGCAATACGAGTGAGAACAAGGGCGACTACAAAAAAATGATATATAACTTGTTGCCA

GGCCCCAACAAGATGATTCCTAAAGTTTTTCTGTCTTCTAAGACTGGAGTTGAAACTTAC

AAACCCTCCGCCTACATTCTTGAAGGGTATAAACAGAATAAGCACATAAAGTCCTCAAAG

GATTTCGACATTACGTTTTGCCATGACCTCATCGACTATTICAAGAACTGTATCGCCATA

CATCCGGAGTGGAAGAATTTTGGATTTGATTTCTCCGACACATCTACCTATGAAGACATA

AGCGGTTTCTACCGGGAGGTCGAGCTTCAGGGCTATAAGATAGATTGGACATACATTAGT

GAAAAAGATATCGATCTTCTGCAAGAAAAGGGACAACTTTACCTTTTTCAGATTTATAAT

AAAGACTTTTCAAAAAAGTCCACAGGGAACGATAATCTGCACACCATGTATCTCAAGAAT

CTGTTTAGTGAAGAAAACCTTAAAGACATAGTTTTGAAGCTTAACGGAGAGGCTGAGATT

TTTTTTAGAAAGTCCTCAATTAAAAACCCTATAATACACAAGAAAGGCTCTATTCTTGTT

AACAGGACATATGAAGCCGAGGAGAAAGATCAGTTTGGCAATATCCAGATTGTTCGCAAG

AATATCCCGGAAAATATATATCAGGAGCTGTATAAATACTTTAACGACAAGAGCGACAAG

GAGCTGAGTGACGAGGCCGCGAAGCTTAAGAATGTAGTAGGTCACCACGAAGCAGCCACC

AATATCGTCAAAGACTATAGGTACACGTACGACAAGTACTTTTTGCACATGCCTATAACT

ATAAACTTCAAAGCTAATAAAACTGGGTTTATTAATGACAGGATTCTCCAATACATCGCT

AAAGAGAAGGATCTGCATGTAATTGGCATAGACAGAGGTGAGAGAAACTTGATATATGTC

AGCGTAATAGACACATGTGGCAATATCGTGGAACAGAAGTCTTTTAACATCGTCAATGGT

TACGACTACCAAATTAAGTTGAAACAGCAGGAAGGCGCACGACAGATCGCACGAAAGGAA

TGGAAAGAGATAGGCAAAATAAAAGAAATAAAGGAGGGCTATCTCAGTCTCGTTATACAC

GAAATTTCAAAAATGGTTATTAAGTACAATGCAATCATAGCGATGGAGGATCTCAGTTAT

GGGTTCAAAAAGGGTCGGTTTAAAGTTGAGCGCCAAGTGTACCAAAAGTTCGAGACAATG

CTGATTAACAAGCTGAACTACCTCGTCTTCAAAGATATAAGTATTACGGAGAACGGTGGC

CTTCTTAAAGGCTATCAACTTACTTACATCCCGGACAAGCTCAAAAACGTAGGGCACCAA

TGCGGGTGTATTTTCTATGTGCCTGCGGCATATACGTCAAAGATTGACCCAACCACAGGA

TTCGTAAACATATTCAAGTTTAAGGACCTCACCGTTGATGCGAAAAGGGAGTTCATTAAA

AAATTTGATTCTATTCGATATGATAGTGAGAAAAATCTCTTTTGTTTCACATTTGACTAT

AATAATTTTATTACTCAGAATACTGTCATGAGCAAGTCATCTTGGTCAGTGTACACATAC

GGGGTGCGGATCAAACGCAGGTTCGTCAATGGTCGCTTCTCAAACGAATCAGACACCATT

GACATCACAAAGGACATGGAAAAAACCCTTGAGATGACCGACATTAATTGGCGCGATGGT

CATGATCTGCGGCAAGACATCATAGACTACGAAATCGTCCAACACATCTTTGAGATCTTT

CGCTTGACGGTCCAAATGCGGAACTCCCTGTCCGAGCTCGAGGATAGAGATTATGATCGG

CTGATATCTCCCGTGCTTAATGAAAATAACATCTTCTACGACTCCGCCAAGGCGGGTGAT

GCCCTGCCGAAGGATGCGGATGCTAATGGCGCTTATTGCATTGCTCTTAAGGGGCTCTAT

GAGATAAAGCAGATCACGGAAAACTGGAAAGAAGACGGTAAGTTTAGTAGAGACAAGCTG

AAGATCTCAAATAAAGACTGGTTTGATTTCATACAGAACAAGCGGTACCTGAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 81
AGCCCAGCGGCTAAAAAAAAGAAACTGGATGGCAGCGTGGATATGAACAATGGCACTAAC

AATTTTCAGAATTTCATCGGCATTTCAAGTCTGCAAAAAACTCTGAGGAATGCTTTGATC

-continued

CCTACTGAAACCACTCAGCAATTTATAGTCAAGAACGGTATAATTAAAGAAGATGAACTC

AGGGGTGAAAATAGACAAATACTCAAGGACATTATGGATGACTATTATAGAGGCTTCATC

TCAGAGACTCTCTCATCAATAGATGATATCGATTGGACTAGCCTTTTCGAGAAAATGGAG

ATTCAGTTGAAAAATGGTGATAACAAAGATACGTTGATAAAGGAACAGACCGAGTACAGG

AAAGCCATTCATAAGAAATTTGCTAATGACGATAGATTTAAGAATATGTTTAGTGCAAAA

CTGATTAGTGACATTCTGCCGGAGTTCGTTATCCATAATAATAACTACTCTGCATCCGAA

AAGGAGGAAAAGACGCAAGTTATTAAACTGTTCAGCCGCTTCGCCACAAGCTTCAAGGAC

TACTTCAAAAATAGAGCCAACTGCTTTTCTGCCGACGATATATCATCATCTTCATGCCAT

CGGATCGTTAACGATAACGCCGAGATATTCTTCAGCAACGCCCTTGTATATCGAAGAATA

GTCAAAAGTCTGAGTAATGATGATATTAATAAAATTAGCGGTGATATGAAAGACTCCCTG

AAGGAAATGTCACTGGAGGAAATTTATAGTTACGAAAAGTACGGCGAATTCATTACTCAA

GAAGGCATATCCTTCTATAACGACATTTGCGGAAAGGTCAACTCATTCATGAACCTTTAT

TGCCAGAAGAATAAGGAGAATAAAAATCTTTACAAATTGCAAAAACTTCACAAACAAATT

CTTTGCATCGCGGATACGTCCTACGAAGTTCCTTACAAATTTGAATCCGATGAGGAAGTG

TATCAGAGTGTCAATGGATTTTTGGATAATATCTCTTCAAAACATATTGTGGAGAGATTG

CGCAAAATAGGTGATAACTACAATGGCTACAACCTGGACAAGATTTATATTGTTAGCAAG

TTCTATGAAAGTGTCAGTCAAAAGACCTACAGAGATTGGGAGACAATCAACACGGCGCTC

GAAATACACTACAATAACATCCTCCCCGGCAATGGGAAGAGTAAAGCCGATAAGGTTAAA

AAAGCTGTTAAGAACGACCTCCAGAAATCCATCACGGAAATAAACGAGCTGGTTTCCAAC

TATAAGCTGTGTAGCGATGATAATATTAAGGCTGAGACATATATACATGAGATCAGCCAC

ATTCTCAACAATTTCGAGGCACAGGAACTCAAATACAATCCCGAGATTCACTTGGTGGAA

AGTGAGTTGAAGGCGTCAGAGCTTAAGAATGTACTTGACGTAATAATGAATGCTTTTCAT

TGGTGCTCCGTGTTCATGACTGAGGAACTCGTGGATAAGGATAATAACTTTTATGCGGAG

TTGGAAGAGATATACGATGAAATATACCCGGTTATCTCACTGTATAATCTGGTCAGAAAT

TACGTGACCCAAAAGCCTTATAGTACAAAAAAAATAAAGTTGAACTTCGGTATTCCGACA

TTGGCAGATGGTTGGTCCAAAAGCAAAGAATACTCTAATAACGCCATTATATTGATGCGA

GACAATTTGTATTACCTTGGGATCTTTAACGCGAAAAACAAACCGGATAAGAAGATCATC

GAAGGTAATACATCTGAGAATAAGGGGGATTACAAGAAGATGATTTATAATCTGTTGCCG

GGGCCAAACAAGATGATTCCGAAGGTCTTTCTGTCATCTAAGACAGGAGTAGAGACCTAC

AAACCTTCTGCGTACATTTTGGAAGGCTACAAACAGAACAAGCATATAAAATCTAGCAAG

GACTTTGATATCACGTTTTGTCATGATCTGATAGATTATTTCAAAAACTGCATCGCTATA

CATCCTGAGTGGAAGAATTTCGGCTTTGACTTTTCTGACACCAGCACATACGAAGACATC

TCAGGTTTCTACCGGGAAGTCGAGCTCCAGGGGTACAAGATTGACTGGACATATATAAGT

GAAAAAGACATCGACCTCCTCCAAGAGAAGGGCCAACTTTACCTGTTCCAGATCTATAAC

AAAGACTTTTCTAAAAAGTCCACGGGTAACGACAACTTGCACACTATGTATCTGAAAAAC

TTGTTCTCTGAAGAGAACCTCAAGGACATCGTCCTGAAGCTTAACGGGGAGGCGGAGATC

TTCTTTAGAAAGTCCTCTATCAAAAATCCCATTATCCATAAAAAGGGCTCTATACTCGTT

AATAGGACATATGAAGCGGAGGAAAAAGATCAATTTGGGAACATCCAGATCGTCCGGAAA

AATATACCTGAGAATATCTATCAAGAGCTGTACAAGTATTTTAATGATAAGTCAGACAAA

GAGCTCAGTGATGAGGCGGCAAAGCTCAAGAACGTGGTGGGGCATCATGAAGCTGCGACG

AACATTGTCAAAGATTATAGATACACTTACGATAAATACTTCCTCCACATGCCGATAACG

-continued

ATTAACTTCAAAGCCAATAAGACGGGGTTTATAAATGATCGGATCCTTCAGTACATTGCG

AAAGAGAAAGACCTCCATGTGATCGGAATTGACCGAGGAGAAAGGAATCTGATTTACGTG

TCCGTGATTGATACTTGCGGGAATATAGTCGAGCAAAAGAGTTTCAACATAGTCAACGGG

TATGACTATCAGATAAAGCTCAAACAGCAGGAAGGTGCGAGGCAAATTGCGCGCAAAGAG

TGGAAGGAGATAGGCAAGATTAAAGAAATCAAGGAAGGTTATCTCAGCTTGGTGATCCAT

GAAATATCTAAGATGGTTATAAAGTACAATGCCATAATAGCCATGGAGGATCTTTCCTAC

GGGTTTAAGAAGGGCCGATTTAAAGTGGAGCGACAAGTTTACCAGAAGTTCGAAACCATG

TTGATTAACAAACTTAACTATTTGGTGTTCAAGGATATAAGTATAACCGAAAACGGCGGT

TTGCTTAAGGGTTATCAGCTCACGTATATTCCTGATAAACTTAAAAACGTTGGACACCAG

TGTGGATGTATCTTCTACGTGCCAGCCGCTTACACTAGTAAGATAGATCCTACCACGGGG

TTTGTGAATATTTTTAAGTTTAAAGACTTGACAGTCGACGCCAAAAGGGAATTTATAAAA

AAGTTTGATTCTATCCGCTACGATAGTGAAAAAAATCTCTTTTGCTTTACTTTCGACTAT

AACAACTTCATTACGCAGAACACTGTCATGAGTAAGTCCAGCTGGAGCGTCTACACATAT

GGCGTCCGAATTAAACGACGATTTGTAAACGGGCGGTTTTCAAACGAATCTGACACGATA

GACATTACCAAGGATATGGAGAAGACACTTGAGATGACCGACATAAACTGGCGGGACGGT

CACGATCTTCGGCAGGACATAATTGATTACGAAATCGTCCAGCATATATTCGAAATATTT

CGACTTACAGTGCAAATGCGGAACAGTCTCTCTGAACTGGAAGATCGCGATTATGACCGG

TTGATTTCTCCGGTCCTCAATGAAAATAACATATTTTATGATAGTGCTAAGGCAGGTGAT

GCGTTGCCAAAGGATGCAGACGCTAATGGTGCCTATTGTATCGCGCTCAAGGGATTGTAC

GAGATAAAGCAAATTACGGAGAACTGGAAGGAGGATGGTAAGTTTAGCCGAGACAAGTTG

AAGATTAGCAATAAAGACTGGTTTGATTTTATCCAAAACAAGAGGTACCTGAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 82
AGCCCAGCGGCTAAAAAAAAGAAACTGGATGGCAGCGTGGATATGAATAACGGAACTAAT

AACTTTCAAAATTTCATAGGTATTTCAAGCTTGCAGAAGACCCTGAGGAATGCCCTGATT

CCAACCGAGACAACGCAGCAGTTCATAGTCAAAAATGGCATTATTAAGGAAGATGAGCTG

CGGGGGGAAAACCGACAGATACTCAAGGATATTATGGACGACTATTACCGGGGATTTATC

TCAGAAACGCTGAGCAGTATTGATGACATCGATTGGACCAGTCTTTTCGAGAAAATGGAA

ATTCAACTTAAGAATGGTGACAATAAAGACACTCTCATAAAGGAGCAAACTGAATACCGA

AAAGCCATACACAAAAAGTTTGCCAACGATGACCGCTTTAAAAACATGTTTTCAGCTAAG

CTCATTAGCGACATTCTCCCCGAGTTTGTGATTCATAACAATAACTATAGCGCATCCGAG

AAGGAGGAAAAAACCCAAGTTATCAAATTGTTCAGTAGATTCGCTACGAGCTTTAAAGAT

TACTTTAAAAACCGGGCTAACTGCTTCAGTGCAGACGATATCAGCTCCTCATCCTGTCAT

CGCATCGTCAATGATAATGCTGAGATCTTCTTTTCTAATGCACTGGTTTACCGCAGGATA

GTTAAGTCTCTTAGTAACGACGACATCAACAAGATATCAGGAGATATGAAGGATTCCCTT

AAAGAAATGAGTCTCGAGGAGATATATTCTTATGAAAAATACGGCGAATTTATTACCCAA

GAGGGCATTAGTTTCTATAATGACATATGCGGAAAAGTTAATAGTTTTATGAATCTCTAT

TGTCAGAAGAATAAGGAGAATAAGAACCTCTACAAATTGCAGAAGTTGCACAAGCAAATT

CTGTGTATCGCGGACACCTCTTACGAGGTCCCATATAAGTTCGAGAGTGATGAAGAAGTA

-continued

TACCAGAGCGTTAATGGGTTCCTGGACAACATCTCAAGTAAACACATAGTCGAAAGGCTC

CGAAAGATCGGTGATAACTATAACGGATATAATTTGGATAAAATTTATATAGTTAGCAAA

TTTTACGAGAGCGTCAGTCAGAAGACCTACCGGGACTGGGAGACCATAAACACAGCGCTG

GAAATACATTATAACAACATACTGCCTGGGAACGGTAAGTCAAAGGCAGACAAGGTTAAA

AAGGCTGTGAAGAATGACCTGCAAAAATCAATTACAGAAATAAATGAGTTGGTAAGTAAT

TACAAACTTTGCAGCGATGATAATATAAAGGCAGAGACGTACATACATGAAATATCTCAT

ATCCTCAACAATTTCGAAGCCCAAGAACTGAAGTACAACCCGGAAATTCATCTTGTAGAG

TCTGAGTTGAAGGCCTCCGAATTGAAAAACGTTCTTGACGTAATTATGAATGCCTTCCAC

TGGTGCTCAGTATTCATGACGGAAGAGCTCGTGGATAAAGACAACAATTTTTACGCTGAA

CTGGAAGAAATATATGACGAGATTTACCCCGTAATTTCACTCTACAACTTGGTACGAAAT

TACGTTACCCAAAAGCCATACTCAACAAAAAAAATTAAACTGAACTTCGGGATACCCACC

CTCGCAGATGGATGGTCAAAGTCCAAAGAGTACAGTAACAATGCAATTATCCTGATGCGA

GACAACCTTTATTACCTCGGGATTTTCAACGCTAAAAATAAACCTGATAAAAAAATAATT

GAGGGTAATACCTCTGAAAACAAGGGGGATTATAAAAAGATGATATACAATCTGCTGCCT

GGCCCGAACAAAATGATTCCTAAAGTCTTCTTGTCTTCCAAGACTGGAGTCGAAACCTAC

AAGCCAAGTGCTTATATACTCGAAGGGTACAAACAAAATAAGCACATAAAATCCAGCAAG

GATTTTGATATTACATTCTGCCACGATTTGATTGATTATTTTAAGAACTGTATAGCCATC

CACCCAGAATGGAAGAATTTTGGTTTTGATTTTAGCGATACCTCAACATATGAGGATATC

TCTGGCTTTTACCGCGAGGTAGAACTGCAAGGTTATAAGATCGATTGGACTTATATTTCT

GAAAAGGACATAGATCTCCTGCAAGAGAAAGGGCAACTTTATTTGTTTCAAATATACAAC

AAAGATTTTAGTAAGAAGAGTACTGGCAATGATAACCTTCACACTATGTATCTGAAGAAC

CTTTTTTCTGAGGAGAACTTGAAGGACATAGTCCTTAAACTCAATGGGGAAGCTGAAATA

TTCTTTCGCAAAAGCTCCATTAAAAACCCGATCATTCATAAAAAGGGTTCCATCTTGGTA

AACCGCACATACGAGGCGGAAGAAAAAGATCAGTTCGGAAATATCCAGATCGTAAGGAAG

AATATCCCCGAAAATATATACCAAGAGCTTTACAAATATTTTAACGATAAGTCAGACAAG

GAACTGTCAGACGAAGCAGCCAAGTTGAAGAATGTCGTAGGGCACCACGAAGCAGCTACA

AACATAGTTAAAGATTATCGGTACACCTACGATAAATATTTCCTGCATATGCCAATAACC

ATAAACTTCAAAGCCAACAAAACAGGGTTCATCAATGACCGAATACTTCAGTATATAGCC

AAGGAAAAAGACCTGCATGTTATAGGAATAGATAGAGGTGAGCGCAACTTGATATATGTC

AGCGTGATAGACACCTGCGGAAATATCGTCGAGCAAAAAAGTTTCAACATTGTTAATGGC

TACGATTACCAAATTAAATTGAAGCAGCAAGAGGGGGCTCGGCAAATCGCGCGAAAGGAA

TGGAAAGAAATCGGGAAGATTAAAGAAATTAAAGAGGGCTACCTGTCTCTTGTAATTCAC

GAAATATCTAAGATGGTCATCAAGTATAATGCCATTATTGCGATGGAAGATCTGTCCTAC

GGATTTAAGAAAGGCAGGTTTAAAGTCGAAAGGCAGGTGTACCAGAAATTCGAGACCATG

CTGATTAATAAGCTCAACTATCTCGTATTTAAGGATATTTCTATAACTGAAAATGGAGGG

CTTCTCAAAGGATATCAACTCACATACATACCTGATAAGCTGAAGAACGTAGGCCACCAG

TGTGGATGCATATTCTATGTACCAGCTGCATACACAAGCAAGATCGATCCAACTACTGGG

TTTGTCAATATCTTCAAATTTAAGGACTTGACGGTCGATGCCAAACGGGAGTTCATCAAA

AAGTTTGATAGTATTCGATATGATAGTGAGAAGAACTTGTTTTGCTTCACATTTGACTAC

AACAATTTCATAACGCAAAATACGGTTATGTCTAAATCCTCATGGAGCGTCTACACTTAC

-continued

GGAGTGAGGATAAAGCGGCGCTTCGTAAATGGCAGGTTTAGCAATGAATCCGACACGATT

GACATAACCAAGGATATGGAGAAAACCCTCGAGATGACCGATATAAATTGGCGGGATGGA

CACGATCTGCGACAAGACATAATCGATTATGAAATCGTGCAGCACATATTTGAGATATTC

AGGCTTACGGTCCAAATGAGAAATTCCCTTTCCGAACTTGAAGACCGCGATTACGACCGA

CTGATAAGCCCCGTTCTGAACGAAAATAACATCTTCTACGACAGCGCTAAAGCGGGAGAC

GCGCTGCCGAAAGATGCGGACGCAAATGGAGCCTATTGTATCGCCTTGAAAGGGTTGTAC

GAGATCAAACAGATAACCGAGAATTGGAAGGAGGATGGGAAGTTTAGTCGAGACAAACTT

AAAATAAGCAACAAGGACTGGTTCGACTTTATTCAAAACAAACGATATCTCAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 83
AGCCCAGCGGCTAAAAAAAAGAAACTGGATGGCAGCGTGGATATGAATAATGGTACTAAC

AATTTTCAAAACTTTATCGGCATCTCTTCACTTCAGAAAACTCTTCGGAACGCCCTTATA

CCGACGGAGACAACGCAGCAGTTTATAGTTAAAAACGGGATCATTAAAGAAGATGAACTC

AGAGGGGAAAACAGGCAAATATTGAAGGACATTATGGACGATTACTACCGGGGGTTTATT

TCAGAGACCCTTTCATCTATTGATGACATAGATTGGACCTCCCTTTTCGAGAAAATGGAG

ATACAATTGAAAAACGGCGACAATAAAGATACACTTATCAAGGAACAAACTGAGTATCGC

AAGGCGATTCACAAGAAGTTTGCGAATGACGATCGCTTTAAGAATATGTTTTCTGCGAAG

CTCATAAGTGACATTCTGCCTGAATTTGTCATTCATAACAACAATTATTCTGCTAGCGAA

AAAGAGGAAAAAACTCAAGTCATTAAGCTTTTTAGCAGGTTCGCTACTAGTTTTAAAGAC

TATTTTAAGAACCGGGCGAATTGCTTTAGCGCTGACGACATATCATCCTCATCCTGTCAT

CGCATAGTCAATGATAATGCAGAAATATTCTTTTCTAATGCGCTCGTGTATCGGAGAATA

GTGAAAAGCCTCTCTAACGATGACATTAACAAAATAAGCGGCGATATGAAGGATAGTCTG

AAGGAAATGTCCCTCGAAGAAATATACTCATACGAGAAGTACGGAGAATTTATCACCCAG

GAAGGAATTAGTTTTTACAACGACATCTGTGGTAAGGTTAACTCTTTTATGAATCTGTAT

TGTCAAAAGAATAAAGAAAATAAAAATCTTTATAAGCTCCAAAAGCTTCACAAACAAATC

TTGTGCATTGCGGATACGTCATACGAAGTACCTTACAAATTTGAAAGCGACGAAGAGGTG

TATCAGTCAGTGAATGGGTTCCTTGACAATATTTCTAGCAAACATATTGTGGAGCGACTT

CGAAAGATCGGTGATAATTACAATGGCTATAATTTGGATAAAATTTACATAGTTAGTAAG

TTTTATGAATCCGTCTCACAAAAGACGTACCGAGATTGGGAGACCATCAACACTGCTCTG

GAGATTCATTACAATAATATATTGCCTGGGAATGGGAAGTCAAAGGCCGACAAGGTTAAA

AAAGCCGTAAAAAACGATCTTCAAAAGTCCATTACCGAGATAAATGAACTTGTATCCAAC

TATAAGTTGTGCTCTGACGATAATATTAAAGCAGAAACGTATATCCACGAAATAAGTCAC

ATCCTGAACAACTTCGAAGCTCAAGAGCTCAAGTATAATCCTGAAATTCATCTCGTCGAA

AGCGAGCTGAAAGCATCCGAGTTGAAGAATGTGCTTGATGTGATCATGAACGCATTCCAT

TGGTGCAGTGTGTTCATGACCGAAGAACTTGTAGACAAAGACAACAACTTCTACGCTGAA

TTGGAAGAGATTTACGATGAAATTTACCCCGTGATATCCCTCTATAATCTGGTAAGAAAT

TACGTCACGCAAAAACCATACAGTACCAAGAAAATAAAGCTCAACTTTGGTATTCCGACG

TTGGCAGATGGGTGGAGTAAGAGCAAGGAGTATTCTAACAATGCAATCATCCTCATGCGC

GACAATTTGTATTATCTGGGGATCTTCAACGCGAAAAATAAGCCCGACAAAAAGATAATA

-continued

GAAGGCAATACGTCCGAGAACAAAGGGGACTATAAGAAAATGATTTATAACCTTCTTCCA

GGACCCAACAAGATGATCCCAAAGGTTTTCTTGAGTTCAAAAACCGGCGTAGAAACTTAT

AAACCGTCCGCCTACATTCTGGAAGGGTACAAGCAAAACAAGCACATTAAGTCATCTAAG

GATTTCGACATTACTTTTTGTCATGATTTGATAGACTACTTCAAAAATTGTATAGCGATA

CATCCGGAATGGAAAAATTTTGGGTTCGATTTTTCCGACACAAGTACTTATGAAGACATC

TCAGGGTTTTATAGGGAAGTTGAACTGCAAGGTTACAAAATAGACTGGACTTATATTAGT

GAGAAGGACATTGATTTGCTCCAGGAAAAGGGTCAATTGTATCTGTTCCAGATATATAAC

AAGGATTTCTCTAAAAAATCTACAGGTAACGACAATCTCCACACGATGTACCTCAAGAAT

CTCTTCAGCGAAGAGAATTTGAAGGATATCGTACTTAAGCTCAATGGAGAAGCGGAAATA

TTCTTCAGAAAGTCCAGCATTAAGAATCCTATAATTCACAAGAAAGGGTCAATTCTCGTA

AACCGGACTTATGAGGCCGAAGAAAAAGATCAGTTTGGTAACATTCAGATTGTACGGAAA

AACATTCCCGAGAACATCTATCAAGAACTGTATAAATACTTTAATGATAAATCCGACAAG

GAACTTTCTGACGAGGCTGCAAAATTGAAGAACGTAGTGGGACACCATGAGGCCGCAACC

AATATAGTAAAGGATTACAGATACACTTATGATAAGTATTTCCTCCATATGCCGATCACG

ATTAATTTCAAGGCGAATAAAACCGGCTTCATTAACGATCGCATTTTGCAATATATTGCG

AAGGAAAAGGATTTGCACGTGATAGGTATAGACCGGGGTGAACGAAACTTGATTTACGTC

TCTGTGATCGACACATGCGGAAATATAGTTGAACAGAAGTCCTTTAATATTGTGAATGGT

TACGACTACCAGATAAAATTGAAGCAACAGGAGGGCGCAAGACAGATAGCTCGCAAAGAG

TGGAAGGAAATCGGCAAGATCAAAGAAATAAAGGAGGGTTATCTTTCCCTGGTAATTCAT

GAAATTAGCAAGATGGTTATTAAGTATAATGCTATAATAGCTATGGAGGACCTTTCCTAT

GGGTTCAAGAAAGGTCGCTTCAAAGTGGAGCGACAAGTGTATCAAAAGTTCGAGACTATG

TTGATAAATAAATTGAATTATTTGGTTTTTAAAGACATTTCAATAACTGAGAACGGGGGT

CTCTTGAAGGGGTACCAATTGACTTATATTCCGGACAAGTTGAAGAATGTCGGACACCAG

TGTGGTTGCATTTTCTACGTGCCTGCCGCTTACACCTCAAAAATCGATCCGACCACTGGT

TTTGTAAATATATTTAAATTCAAAGATCTCACCGTTGATGCCAAACGGGAGTTTATCAAA

AAATTCGATTCCATTCGCTACGACTCTGAGAAAAACCTTTTTTGTTTCACGTTCGATTAT

AACAACTTTATAACCCAAAATACTGTAATGTCCAAGTCAAGTTGGTCTGTCTATACTTAC

GGAGTAAGGATCAAGCGCCGCTTCGTTAATGGGAGATTCTCAAACGAGTCTGATACCATA

GACATAACTAAAGACATGGAAAAAACCCTGGAAATGACGGACATCAATTGGCGAGACGGG

CATGATCTTCGACAGGACATAATAGATTACGAAATTGTTCAACACATTTTCGAGATATTT

CGACTTACGGTTCAGATGAGGAATTCCCTTTCCGAATTGGAAGACCGGGATTATGATCGA

CTTATATCTCCCGTGCTCAATGAAAACAATATTTTTTATGATTCAGCGAAAGCTGGGGAC

GCGCTGCCAAAAGATGCCGATGCCAATGGAGCATACTGTATCGCCCTGAAGGGTTTGTAT

GAGATTAAGCAAATTACTGAAAACTGGAAGGAAGATGGCAAGTTTTCTAGAGATAAGCTT

AAGATTAGCAATAAGGACTGGTTTGACTTCATTCAAAATAAAAGGTATCTTAAACGTCCG

GCAGCGACCAAAAAAGCCGGCCAGGCGAAGAAAAAAAAAGCGTCAGGTAGCGGCGCAGGC

AGCCCGAAAAAGAAACGTAAAGTCGAGGATCCGAAAAAGAAACGTAAGGTTATTCCGGGC

TAA

SEQ ID NO: 84
AGCCCAGCGGCTAAAAAAAAGAAACTGGATGGCAGCGTGGATATGAATAATGGAACAAAT

AATTTTCAAAATTTTATTGGTATCAGTTCATTGCAAAAGACTTTGAGAAATGCTTTGATC

-continued

CCGACTGAGACCACACAGCAGTTCATCGTCAAAAATGGCATAATCAAGGAAGACGAACTT

AGGGGTGAGAATAGACAAATATTGAAGGACATCATGGATGACTATTATAGGGGGTTCATT

TCCGAAACGCTCAGTAGTATTGATGACATTGACTGGACTAGTCTTTTCGAGAAAATGGAA

ATTCAGCTTAAGAACGGGGACAATAAAGACACGCTGATCAAGGAGCAAACGGAATATAGG

AAGGCGATCCATAAAAAATTCGCGAATGATGATCGGTTTAAAAACATGTTTAGTGCCAAG

TTGATCAGCGACATACTGCCCGAATTCGTGATCCACAACAATAATTACAGCGCCTCCGAA

AAGGAGGAAAAAACTCAGGTCATTAAATTGTTTAGCCGATTCGCAACGAGTTTCAAAGAT

TATTTTAAGAACCGGGCCAACTGTTTTTCAGCGGATGATATTAGCTCCAGCAGCTGCCAT

CGCATAGTAAATGATAACGCTGAAATCTTTTTTAGCAACGCACTTGTCTACCGGAGGATT

GTAAAATCACTGTCAAATGATGACATTAACAAAATATCTGGAGATATGAAGGACTCACTC

AAAGAAATGAGCCTGGAAGAAATATATTCATACGAAAAATACGGGGAGTTTATTACCCAG

GAAGGTATCAGTTTTTATAATGATATATGTGGAAAAGTTAATTCATTTATGAATCTTTAC

TGTCAAAAAAATAAGGAGAACAAGAATTTGTACAAGCTCCAAAAACTTCATAAACAGATT

CTGTGCATCGCAGACACAAGTTATGAGGTACCGTACAAATTTGAGAGCGACGAAGAAGTT

TATCAGAGTGTGAATGGTTTCCTGGACAATATCTCTTCTAAACACATTGTTGAGAGGCTT

AGGAAGATCGGTGATAATTATAACGGCTATAATCTGGACAAAATTTATATTGTATCAAAG

TTTTATGAATCAGTCTCTCAAAAGACGTATCGGGATTGGGAAACAATTAACACGGCTCTG

GAGATCCACTACAATAACATTCTGCCCGGCAACGGGAAGAGCAAAGCTGATAAGGTCAAG

AAGGCAGTCAAGAACGACCTTCAGAAGAGCATAACAGAAATTAACGAATTGGTCAGTAAC

TACAAACTGTGTAGTGATGACAACATAAAAGCCGAAACATACATCCATGAAATAAGCCAT

ATCCTGAATAACTTCGAAGCCCAAGAACTTAAATACAATCCCGAGATTCATCTTGTCGAA

TCAGAACTCAAGGCGTCCGAGCTCAAAAATGTCCTTGACGTGATAATGAATGCCTTCCAC

TGGTGCAGCGTATTCATGACGGAGGAGTTGGTAGATAAAGACAACAACTTTTATGCCGAA

TTGGAAGAGATTTATGATGAGATTTACCCCGTTATTTCTCTGTACAACTTGGTTCGAAAC

TACGTAACACAAAAACCATACTCAACCAAAAAGATCAAACTCAATTTTGGCATACCTACA

TTGGCTGATGGTTGGTCCAAGTCAAAGGAATATAGCAATAATGCAATAATTCTCATGCGA

GATAACTTGTATTATTTGGGGATCTTTAACGCTAAGAACAAACCAGATAAAAAGATAATC

GAGGGGAACACAAGTGAGAACAAGGGTGATTACAAAAAAATGATTTACAATCTGCTTCCT

GGGCCTAACAAAATGATTCCGAAGGTGTTTCTTAGCTCTAAAACTGGAGTGGAGACGTAT

AAGCCTTCCGCGTACATTCTCGAAGGCTACAAGCAAAATAAGCATATCAAGTCCAGTAAG

GACTTCGACATCACTTTTTGCCACGATCTCATCGATTACTTTAAGAACTGTATCGCAATA

CACCCCGAGTGGAAAAACTTTGGTTTTGATTTTTCAGACACTAGTACCTACGAGGACATT

TCCGGCTTCTATCGAGAAGTCGAACTCCAGGGCTACAAAATCGATTGGACGTACATTTCT

GAGAAGGACATCGACTTGCTCCAAGAGAAAGGTCAACTTTACCTCTTCCAAATTTACAAT

AAAGACTTTTCAAAGAAGAGCACCGGTAATGACAACTTGCATACCATGTATCTGAAGAAC

CTGTTTTCTGAGGAGAACCTCAAGGATATTGTATTGAAGTTGAATGGCGAAGCAGAAATA

TTTTTCCGAAAGTCATCTATCAAGAACCCCATTATACACAAAAAAGGCTCTATCCTGGTG

AACCGGACTTACGAGGCAGAGGAGAAGGATCAATTCGGAAACATACAGATAGTCCGCAAA

AACATCCCTGAGAATATCTATCAGGAACTCTATAAGTACTTCAATGATAAATCAGACAAG

GAGCTTAGCGACGAAGCAGCTAAACTTAAAAACGTGGTTGGCCATCACGAGGCCGCTACC

AACATAGTCAAAGACTACCGCTATACTTATGACAAGTACTTTTTGCACATGCCCATAACA

-continued

ATTAATTTCAAAGCTAACAAAACAGGGTTTATAAATGACAGAATCCTCCAATACATCGCC
AAAGAGAAGGACCTCCATGTAATCGGGATTGATAGAGGCGAACGGAACTTGATTTACGTT
AGTGTCATTGATACCTGTGGTAACATTGTCGAACAAAAGTCATTCAACATAGTCAATGGA
TATGATTATCAGATAAAACTCAAGCAACAAGAAGGCGCGAGGCAGATTGCCAGGAAGGAA
TGGAAAGAAATCGGGAAGATCAAGGAGATCAAGGAGGGTTACCTGTCCTTGGTGATACAC
GAGATTTCAAAAATGGTTATAAAATACAATGCCATTATCGCGATGGAGGATTTGTCTTAT
GGATTTAAGAAGGGGAGGTTCAAAGTCGAACGACAAGTCTATCAGAAGTTTGAAACAATG
CTCATTAACAAGCTCAATTACCTTGTTTTCAAGGATATAAGCATCACTGAAAACGGCGGA
CTCCTTAAGGGATATCAGCTGACTTATATCCCCGACAAGCTCAAGAACGTAGGGCACCAA
TGCGGATGCATCTTTTACGTGCCTGCAGCATATACTTCAAAAATTGATCCGACTACTGGC
TTTGTTAACATTTTCAAGTTCAAGGATCTGACGGTAGACGCTAAGAGAGAATTCATAAAA
AAGTTTGACAGCATCAGGTACGATAGTGAAAAGAACCTTTTTTGTTTTACCTTTGACTAC
AATAATTTTATTACGCAAAATACAGTTATGAGCAAATCAAGTTGGAGCGTTTACACATAT
GGCGTTCGGATCAAGCGCAGATTCGTCAATGGTCGCTTCTCAAATGAGAGCGATACAATC
GATATAACGAAGGATATGGAGAAGACGCTTGAGATGACAGATATCAACTGGCGGGACGGA
CATGACCTTAGACAAGACATAATCGATTACGAAATAGTACAGCATATCTTTGAGATTTTT
AGGCTTACAGTTCAGATGCGGAACTCTCTTTCCGAACTGGAGGACCGGGATTATGATCGG
TTGATCTCCCCAGTACTGAACGAAAATAATATCTTTTACGATAGCGCGAAGGCTGGTGAT
GCACTCCCAAAAGACGCTGATGCGAACGGAGCTTATTGCATAGCCCTTAAAGGGCTTTAC
GAGATTAAACAAATAACAGAAAATTGGAAGGAAGATGGCAAATTTTCCCGCGACAAGTTG
AAGATTAGTAACAAAGACTGGTTCGACTTCATTCAGAATAAACGCTACCTCAAACGTCCG
GCAGCGACCAAAAAAGCCGGCCAGGCGAAGAAAAAAAAAGCGTCAGGTAGCGGCGCAGGC
AGCCCGAAAAAGAAACGTAAAGTCGAGGATCCGAAAAAGAAACGTAAGGTTATTCCGGGC
TAA

SEQ ID NO: 85
CCAGCGGCTAAAAAAAAGAAACTGGATGGCAGCGTGGATATGAATAACGGTACCAATAAC
TTCCAGAACTTCATCGGTATTTCTAGCCTGCAAAAGACCCTGCGTAACGCGCTGATTCCG
ACCGAGACTACCCAGCAATTCATCGTGAAAAACGGTATCATTAAGGAAGATGAATTGCGC
GGTGAGAATCGTCAGATTCTGAAAGATATCATGGATGACTACTATCGCGGTTTCATTAGC
GAAACCCTGTCGAGCATCGATGATATCGATTGGACGAGCCTCTTCGAGAAAATGGAAATT
CAACTGAAAAATGGTGACAACAAAGATACCCTGATTAAAGAACAAACGGAATACCGCAAG
GCAATCCATAAAAAGTTTGCGAATGACGACCGTTTTAAGAATATGTTCTCGGCCAAGCTG
ATTTCCGACATCCTGCCAGAGTTCGTCATTCACAACAACAATTACAGCGCAAGCGAGAAA
GAGGAAAAGACTCAGGTCATTAAGCTGTTTAGCCGCTTTGCGACGTCCTTCAAAGACTAC
TTCAAGAATCGTGCGAATTGCTTTAGCGCGGATGACATCTCTAGCTCTAGCTGTCACCGT
ATTGTTAACGACAATGCAGAGATTTTCTTCAGCAACGCCCTGGTGTATCGCCGTATTGTC
AAGTCTCTGAGCAACGACGACATTAACAAGATCAGCGGCGACATGAAAGACAGCCTGAAA
GAAATGTCTCTGGAAGAAATCTACAGCTACGAGAAATATGGTGAGTTTATCACCCAAGAG
GGCATTAGCTTCTACAATGATATCTGTGGTAAGGTTAATAGCTTTATGAATCTGTACTGC
CAGAAGAATAAAGAAAACAAGAACTTGTACAAGCTGCAAAAGCTGCATAAGCAAATTCTG
TGCATCGCCGATACTAGCTATGAAGTTCCGTACAAGTTCGAGTCTGATGAAGAGGTGTAT

-continued

```
CAGTCAGTCAACGGTTTTCTGGATAACATCAGCAGCAAGCACATCGTCGAGCGCCTGCGC
AAGATTGGTGACAACTACAATGGTTATAACCTGGACAAGATCTATATCGTGTCGAAGTTT
TACGAGAGCGTGTCCCAGAAAACGTACCGTGATTGGGAAACGATTAACACGGCCTTGGAA
ATTCACTATAACAATATCCTGCCGGGCAACGGCAAGAGCAAAGCTGACAAAGTCAAAAAA
GCTGTGAAAAACGATCTGCAAAAGTCCATCACCGAGATCAACGAACTGGTTAGCAACTAT
AAGCTGTGTAGCGACGACAACATTAAAGCTGAAACGTATATCCACGAAATCAGCCACATC
CTGAATAACTTTGAGGCACAAGAACTGAAATACAATCCTGAGATCCATCTGGTAGAGAGC
GAGCTGAAGGCAAGCGAGTTGAAAAACGTTCTCGACGTTATCATGAATGCTTTCCACTGG
TGTAGCGTGTTTATGACCGAAGAACTGGTTGACAAAGATAACAATTTCTATGCAGAGCTG
GAAGAAATCTATGATGAAATCTACCCGGTCATCAGCCTGTATAACCTGGTTCGTAACTAC
GTGACGCAGAAGCCGTACAGCACCAAAAAGATCAAGCTGAACTTCGGTATTCCGACCTTG
GCGGACGGTTGGAGCAAATCCAAAGAATACTCCAATAATGCGATTATTCTGATGCGTGAT
AATCTGTACTATCTGGGTATCTTCAATGCGAAGAACAAGCCAGATAAAAAGATTATTGAA
GGCAACACCAGCGAGAATAAAGGCGACTACAAGAAAATGATCTACAACTTATTGCCGGGT
CCGAACAAGATGATCCCGAAAGTTTTTCTGAGCAGCAAGACCGGCGTTGAAACCTATAAG
CCGAGCGCGTACATTTTAGAGGGCTATAAACAAAACAAGCACATCAAGAGCAGCAAAGAT
TTTGATATTACGTTCTGCCACGACCTGATCGACTATTTCAAGAATTGTATTGCGATTCAC
CCTGAGTGGAAGAACTTCGGTTTTGACTTTTCCGATACCTCCACCTATGAAGATATTAGC
GGTTTTTACCGTGAAGTCGAGTTGCAGGGTTATAAGATTGATTGGACTTACATTTCCGAG
AAAGACATCGACCTGTTGCAAGAGAAAGGTCAGCTGTACCTGTTTCAGATCTATAACAAA
GATTTCAGCAAAAAGTCGACGGGCAATGATAATCTGCACACCATGTATCTGAAAAACCTG
TTTAGCGAAGAGAACCTGAAAGACATTGTTCTTAAGCTGAATGGTGAGGCCGAGATCTTC
TTCCGTAAAAGCTCCATTAAGAACCCGATTATCCACAAAAAGGGCTCTATTCTGGTTAAC
CGCACGTACGAAGCGGAAGAGAAAGATCAATTTGGTAACATCCAGATCGTGCGTAAGAAT
ATCCCGGAGAACATTTACCAAGAACTGTATAAGTATTTCAATGACAAGAGCGATAAAGAA
TTGAGCGATGAAGCGGCAAAGCTGAAAAACGTCGTTGGCCACCACGAAGCCGCGACGAAT
ATCGTGAAAGATTATCGTTACACCTACGACAAGTACTTTCTGCACATGCCGATCACCATC
AATTTCAAAGCGAATAAAACGGGTTTTATCAATGACCGTATCCTGCAGTACATTGCGAAA
GAAAAAGATTTACACGTGATTGGTATTGATCGCGGCGAGCGCAATCTGATTTACGTCAGC
GTTATCGACACGTGCGGCAATATTGTGGAGCAGAAAAGCTTCAATATCGTCAATGGTTAC
GACTACCAGATCAAACTGAAGCAACAAGAGGGCGCCCGCCAGATTGCGCGTAAAGAGTGG
AAAGAAATCGGTAAGATTAAAGAAATCAAGGAAGGCTACCTGTCCCTGGTGATCCATGAA
ATCAGCAAAATGGTGATCAAGTACAACGCTATCATTGCGATGGAAGATCTGAGCTACGGT
TTTAAAAAGGGTCGCTTCAAAGTTGAGCGTCAAGTGTATCAGAAATTTGAGACTATGCTG
ATTAACAAGTTGAACTATCTGGTTTTTAAAGACATCAGCATTACCGAGAATGGTGGCCTG
CTGAAGGGTTATCAACTGACCTATATTCCTGACAAGTTGAAAAATGTTGGTCATCAGTGT
GGTTGCATTTTCTACGTACCGGCAGCGTACACGAGCAAGATTGACCCGACCACGGGTTTC
GTTAACATTTTCAAGTTTAAAGATTTGACCGTGGACGCCAAGCGTGAGTTCATTAAAAAG
TTCGACAGCATCAGATACGACTCTGAGAAGAATCTGTTCTGCTTTACGTTCGACTACAAT
AACTTCATTACCCAAAATACCGTTATGAGCAAAAGCTCCTGGAGCGTGTACACGTACGGC
```

-continued

GTCCGTATCAAGCGTCGTTTTGTGAATGGTCGCTTTTCCAACGAATCTGACACCATTGAC

ATTACCAAAGATATGGAAAAGACCCTTGAGATGACCGACATTAATTGGCGTGATGGCCAT

GACTTGCGCCAAGACATTATCGACTACGAAATTGTTCAGCACATCTTTGAGATTTTTCGT

CTGACGGTCCAGATGCGCAACTCGCTGAGCGAGTTGGAAGATCGTGACTATGACCGTCTG

ATTAGCCCGGTGCTGAATGAAAACAATATCTTCTATGATAGCGCAAAGGCCGGTGACGCG

CTGCCGAAAGATGCGGATGCTAACGGTGCATACTGCATTGCACTGAAGGGTCTGTACGAA

ATCAAACAGATCACCGAGAATTGGAAAGAGGATGGTAAGTTTAGCCGTGATAAGCTGAAG

ATTAGCAATAAAGACTGGTTCGACTTTATTCAAAACAAGCGCTATCTGAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 86

CCAGCGGCTAAAAAAAAGAAACTGGATGGCAGCGTGGATATGAACAACGGAACAAATAAT

TTTCAGAACTTTATTGGGATCAGTTCGCTTCAGAAAACGCTTCGTAATGCTCTGATTCCC

ACAGAAACCACTCAGCAGTTTATCGTAAAGAATGGCATTATCAAGGAGGATGAATTACGC

GGCGAGAACCGCCAAATCTTAAAAGATATCATGGACGACTACTACCGCGGTTTCATTAGC

GAAACTCTTAGTTCAATTGACGACATTGACTGGACGTCCTTGTTCGAAAAGATGGAGATT

CAATTAAAGAACGGTGATAACAAGGATACGTTGATTAAAGAACAGACGGAGTACCGTAAG

GCTATCCACAAAAAATTTGCAAACGACGACCGCTTTAAAAATATGTTTAGCGCAAAATTA

ATCTCCGACATCCTGCCTGAATTCGTCATCCATAACAATAACTATAGCGCCTCGGAAAAA

GAAGAAAAAACGCAGGTTATTAAACTTTTCTCGCGCTTTGCAACAAGCTTTAAGGATTAC

TTCAAAAATCGCGCCAATTGTTTTTCAGCCGACGACATTAGCTCCAGTTCCTGCCACCGT

ATTGTGAATGACAACGCTGAGATTTTTTTTTCCAATGCGCTGGTTTATCGTCGTATTGTT

AAGAGCCTTAGTAACGACGACATTAATAAAATTAGCGGTGATATGAAGGATAGCTTGAAA

GAAATGAGTCTGGAAGAGATCTATAGTTACGAGAAGTACGGCGAATTTATTACCCAGGAG

GGCATTTCATTTTACAATGATATCTGTGGAAAAGTCAACTCCTTTATGAACTTGTATTGC

CAAAAGAATAAAGAAAACAAAAACCTGTACAAACTGCAAAAGTTACACAAGCAGATTTTG

TGTATCGCAGACACGTCATACGAAGTACCGTACAAGTTTGAGTCCGATGAAGAAGTGTAC

CAAAGCGTTAATGGCTTTTTGGATAACATTTCGAGCAAACATATCGTAGAGCGTTTGCGT

AAGATTGGTGATAATTACAACGGTTACAATTTAGACAAAATCTATATCGTCTCTAAGTTT

TACGAAAGTGTTTCTCAGAAAACTTACCGCGATTGGGAGACGATCAACACTGCGCTGGAG

ATTCATTACAATAATATCCTTCCAGGTAACGGTAAAAGCAAAGCTGATAAGGTGAAAAAG

GCGGTTAAAAATGACCTTCAAAAGTCTATCACAGAAATCAACGAATTGGTCAGCAATTAT

AAGCTTTGCAGTGACGATAACATTAAGGCCGAGACTTACATCCATGAGATCTCTCACATT

CTTAATAATTTTGAAGCGCAAGAGCTGAAATACAATCCTGAAATCCATCTGGTCGAAAGT

GAATTAAAAGCCTCCGAATTAAAAAATGTCTTGGACGTGATCATGAATGCGTTCCATTGG

TGCTCAGTTTTTATGACGGAAGAGTTGGTGGACAAAGACAACAATTTTTACGCCGAGCTT

GAGGAAATTTACGACGAAATTTACCCCGTTATTTCGTTATACAACCTTGTGCGTAATTAC

GTTACACAAAAGCCCTATTCGACAAAGAAAATCAAGTTAAATTTCGGGATTCCCACATTA

GCTGATGGATGGTCCAAATCCAAAGAATACTCGAATAACGCTATCATCCTTATGCGTGAT

AATTTGTACTACTTAGGCATCTTCAATGCGAAGAACAAACCTGACAAGAAAATTATCGAA

GGAAACACTTCGGAGAACAAAGGTGATTATAAAAAGATGATCTACAACTTGCTTCCCGGG

-continued

CCAAACAAAATGATTCCCAAGGTATTTTTGAGTTCTAAAACCGGTGTCGAAACTTACAAA

CCAAGTGCTTATATTTTGGAAGGATACAAACAGAACAAACATATCAAGTCTTCGAAAGAC

TTCGATATTACGTTCTGCCACGATCTGATCGATTACTTCAAGAACTGTATTGCTATTCAC

CCCGAGTGGAAGAACTTTGGATTTGATTTCTCCGACACGTCCACTTATGAAGATATCTCT

GGCTTCTATCGCGAGGTTGAATTACAAGGGTATAAGATTGACTGGACTTATATTTCGGAG

AAGGATATCGATCTTTTGCAAGAAAAAGGGCAACTTTATTTATTTCAGATCTATAACAAG

GACTTTTCAAAAAAGAGCACTGGAAATGACAATCTGCATACCATGTACCTTAAGAACCTG

TTCTCGGAAGAGAACCTGAAGGACATTGTACTTAAACTGAATGGAGAGGCAGAGATCTTC

TTTCGCAAATCAAGCATTAAGAACCCAATTATTCACAAAAAGGGGAGTATCTTAGTAAAT

CGCACATATGAGGCTGAGGAAAAAGATCAGTTTGGTAACATTCAGATCGTGCGTAAGAAC

ATTCCTGAAAATATCTATCAGGAACTTTATAAGTATTTCAACGATAAAAGTGATAAAGAG

CTGAGTGACGAAGCGGCTAAACTTAAGAATGTTGTGGGACACCATGAGGCAGCAACCAAT

ATTGTGAAGGATTATCGCTATACGTACGACAAATACTTTTTACACATGCCCATCACTATT

AATTTTAAAGCTAATAAGACTGGCTTCATTAACGATCGCATCCTGCAGTACATTGCTAAG

GAAAAGGATCTTCACGTTATCGGTATCGATCGCGGGGAGCGTAATCTTATCTACGTCTCT

GTCATTGACACGTGTGGCAATATTGTGGAGCAAAAGTCCTTCAATATTGTTAACGGCTAT

GACTATCAGATTAAATTGAAACAGCAGGAAGGTGCGCGTCAGATTGCCCGCAAGGAATGG

AAGGAAATTGGCAAGATCAAAGAAATTAAGGAGGGCTACTTAAGCTTAGTAATTCACGAA

ATTAGTAAAATGGTTATCAAATACAACGCCATCATCGCGATGGAGGATCTTTCGTACGGG

TTTAAGAAAGGTCGTTTTAAAGTGGAGCGTCAGGTGTACCAGAAATTTGAAACTATGCTT

ATTAACAAACTTAACTACCTGGTTTTCAAGGATATCAGTATTACTGAAAACGGGGGGCTG

TTAAAAGGGTATCAATTAACTTACATTCCAGACAAATTAAAGAACGTTGGACATCAGTGT

GGCTGCATTTTTTATGTACCAGCTGCATACACTTCAAAGATCGATCCTACGACTGGGTTC

GTGAACATTTTTAAGTTTAAAGACTTGACGGTAGATGCCAAGCGCGAATTCATCAAGAAA

TTCGACAGCATTCGCTACGACTCTGAGAAAAATCTTTTCTGTTTCACATTCGATTATAAC

AATTTCATTACGCAGAACACAGTAATGTCCAAGTCTTCTTGGAGTGTTTATACATATGGT

GTCCGCATTAAGCGCCGTTTCGTCAACGGCCGCTTCAGTAATGAGAGCGATACTATTGAC

ATCACAAAAGACATGGAAAAAACACTGGAAATGACCGACATCAATTGGCGTGACGGCCAT

GACTTACGTCAGGATATCATTGATTATGAGATCGTTCAACACATCTTCGAAATCTTTCGC

TTGACTGTTCAAATGCGCAATTCCTTGTCGGAATTGGAGGACCGTGATTATGACCGCTTA

ATTTCCCCCGTCTTAAATGAAAACAATATTTTTTATGACTCTGCAAAAGCTGGAGATGCT

CTGCCGAAAGACGCCGATGCAAATGGGGCATATTGCATTGCTTTAAAGGGGCTTTACGAG

ATCAAGCAAATCACCGAAAACTGGAAAGAGGATGGAAAGTTTTCGCGTGATAAACTGAAG

ATCTCTAACAAAGACTGGTTCGACTTTATCCAGAACAAGCGTTATTTGAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 87
CCAGCGGCTAAAAAAAAGAAACTGGATGGCAGCGTGGATATGAACAACGGCACCAATAAC

TTCCAAAACTTCATCGGGATCTCTAGCCTTCAGAAGACGCTTCGCAATGCTCTTATCCCA

ACTGAGACCACTCAACAATTTATTGTGAAGAATGGAATTATTAAAGAGGACGAACTGCGT

-continued

GGCGAGAATCGTCAGATCTTAAAGGACATTATGGATGATTATTACCGTGGATTCATCTCC

GAAACATTATCGTCGATCGATGATATCGATTGGACTTCTCTGTTCGAGAAAATGGAAATT

CAATTGAAAAACGGAGATAATAAAGATACGCTTATCAAAGAACAGACGGAATATCGTAAA

GCGATTCATAAGAAATTCGCAAATGACGATCGTTTCAAAAATATGTTCAGTGCCAAGCTT

ATTTCGGACATTTTACCTGAATTTGTAATTCATAATAATAACTACTCAGCAAGTGAGAAG

GAGGAGAAAACCCAAGTTATTAAACTGTTCTCTCGTTTCGCAACGTCCTTTAAAGATTAC

TTTAAAAACCGCGCGAATTGCTTTAGCGCTGACGACATTTCCAGCTCATCCTGTCATCGC

ATCGTAAACGACAATGCGGAAATCTTCTTCAGCAACGCCCTGGTTTACCGCCGCATCGTC

AAAAGCTTATCGAATGACGACATCAATAAGATCTCAGGAGATATGAAGGACTCGCTTAAG

GAGATGTCTCTGGAGGAAATTTATAGTTACGAAAAGTATGGAGAGTTCATTACCCAGGAG

GGAATCTCGTTCTACAATGACATTTGCGGGAAGGTGAACTCCTTCATGAACTTATACTGC

CAGAAAAACAAAGAGAACAAAAATCTGTATAAATTGCAGAAATTACATAAACAGATTCTT

TGTATTGCTGACACTTCCTACGAAGTACCCTATAAATTCGAGTCAGATGAAGAAGTATAC

CAGTCCGTGAACGGATTTCTGGACAATATCTCCTCAAAACACATCGTGGAACGCTTACGT

AAAATTGGCGATAATTATAATGGTTACAATCTTGACAAAATTTATATCGTATCTAAATTT

TACGAGAGTGTGAGCCAAAAGACCTACCGCGACTGGGAGACCATCAACACAGCTTTAGAA

ATTCACTATAATAATATCTTACCCGGCAATGGTAAGAGCAAGGCTGACAAGGTAAAAAAG

GCCGTCAAGAATGATTTGCAGAAATCTATTACAGAAATTAATGAGTTAGTCTCCAACTAT

AAGCTTTGTTCCGACGATAACATCAAAGCTGAGACATATATTCATGAGATTAGTCACATT

CTTAACAACTTCGAGGCCCAGGAACTTAAGTACAATCCTGAAATTCATCTTGTCGAGTCT

GAGCTGAAAGCTAGTGAATTGAAAAATGTTTTAGACGTTATTATGAACGCATTCCACTGG

TGCTCTGTGTTTATGACAGAAGAACTGGTCGACAAGGACAATAACTTCTATGCCGAACTT

GAGGAAATCTACGATGAAATTTACCCTGTAATCTCCTTGTATAATCTTGTACGTAATTAC

GTCACTCAAAAACCTTACAGCACGAAAAAAATTAAATTGAACTTCGGGATTCCTACACTT

GCCGACGGGTGGTCTAAATCCAAGGAATATAGCAACAATGCCATTATTTTAATGCGCGAC

AATCTTTACTATTTAGGAATTTTTAACGCTAAGAACAAGCCCGATAAAAAGATTATTGAA

GGAAACACGTCTGAAAATAAGGGCGACTACAAAAAGATGATTTATAACCTTTTGCCCGGT

CCAAACAAAATGATCCCAAAGGTATTCCTGTCATCCAAAACAGGGGTTGAGACATATAAG

CCCAGCGCATATATTCTGGAAGGATACAAACAGAATAAACATATCAAAAGCAGCAAAGAT

TTTGACATTACTTTTTGCCACGATTTAATCGACTACTTCAAAAACTGTATCGCTATCCAC

CCTGAATGGAAGAATTTCGGATTTGATTTCTCAGATACAAGTACGTATGAGGATATCAGC

GGTTTCTATCGCGAAGTTGAACTTCAAGGGTATAAAATTGACTGGACCTACATTAGTGAG

AAGGACATCGACCTGTTACAGGAAAAAGGCCAATTGTACTTGTTTCAGATCTACAATAAG

GATTTCTCAAAAAAATCGACCGGCAATGATAACTTGCACACCATGTACCTGAAGAACCTT

TTTTCGGAGGAAAACCTTAAAGACATTGTCCTGAAGTTGAATGGAGAAGCGGAGATTTTC

TTTCGTAAGTCTTCCATTAAAAATCCAATTATTCATAAGAAGGGCAGCATCCTTGTGAAC

CGTACGTACGAGGCGGAAGAGAAGGACCAATTCGGTAACATTCAAATCGTCCGCAAGAAC

ATCCCTGAAAATATTTATCAGGAGCTTTACAAGTATTTCAATGATAAGTCCGACAAGGAA

TTATCAGATGAGGCTGCGAAGTTGAAAAATGTTGTTGGTCATCACGAGGCGGCGACGAAT

ATTGTAAAGGATTATCGCTACACTTATGACAAGTACTTTCTGCACATGCCGATCACCATT

AATTTCAAGGCGAACAAAACAGGATTTATTAATGACCGCATCTTACAATACATTGCCAAA

-continued

GAAAAGGACTTACACGTTATTGGCATTGATCGTGGAGAACGCAACTTAATCTACGTAAGC

GTTATTGACACTTGCGGGAATATCGTAGAACAAAAGAGCTTCAACATCGTGAATGGTTAC

GATTACCAGATCAAGCTTAAGCAGCAGGAGGGAGCGCGCCAGATCGCGCGCAAGGAATGG

AAGGAGATTGGTAAGATCAAGGAAATCAAGGAAGGTTATCTGTCCTTGGTAATCCACGAA

ATTTCGAAAATGGTTATCAAATACAATGCTATTATTGCAATGGAGGACTTGTCCTACGGC

TTTAAAAAAGGACGCTTTAAGGTGGAGCGCCAGGTTTATCAAAAGTTTGAAACAATGCTG

ATTAACAAGCTGAACTATTTGGTCTTTAAAGATATCTCCATCACCGAAAATGGTGGGCTT

TTGAAAGGCTATCAACTTACATATATCCCTGATAAGCTTAAGAATGTGGGTCATCAGTGC

GGGTGCATTTTTTATGTTCCTGCAGCCTACACGTCCAAAATCGATCCTACAACTGGATTT

GTTAATATCTTCAAATTTAAGGATCTTACCGTCGACGCGAAGCGCGAATTTATCAAGAAA

TTCGATAGTATTCGTTATGATTCCGAAAAAAACCTTTTCTGTTTCACCTTTGATTATAAT

AACTTTATCACGCAAAATACTGTCATGAGCAAATCGAGTTGGTCTGTGTACACTTACGGA

GTACGCATCAAGCGTCGTTTTGTTAATGGGCGCTTCAGTAACGAGTCAGACACGATTGAT

ATCACAAAAGATATGGAGAAAACGCTGGAGATGACAGACATCAATTGGCGCGATGGTCAT

GACTTACGTCAAGACATTATCGATTATGAAATTGTCCAGCATATCTTTGAGATCTTTCGT

TTGACTGTTCAGATGCGCAACAGCCTGTCAGAATTGGAGGATCGTGACTATGATCGCCTT

ATTTCTCCCGTCTTAAATGAGAACAATATCTTCTACGACTCAGCCAAGGCTGGAGATGCA

CTGCCAAAAGACGCCGACGCAAATGGGGCCTACTGTATTGCATTGAAGGGGTTGTACGAG

ATCAAACAGATTACAGAAAATTGGAAGGAGGACGGTAAGTTCTCTCGTGATAAGCTGAAG

ATTTCTAACAAAGACTGGTTCGATTTCATTCAGAACAAACGTTACCTGAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 88
CCAGCGGCTAAAAAAAAGAAACTGGATGGCAGCGTGGATATGAACAACGGTACCAATAAC

TTTCAGAATTTCATTGGAATCAGCAGCTTACAGAAAACCCTGCGCAATGCACTTATCCCC

ACTGAGACAACCCAGCAGTTCATTGTAAAGAACGGGATTATTAAAGAAGATGAGCTTCGC

GGGGAGAATCGTCAGATCTTAAAGGATATTATGGACGATTACTACCGTGGCTTCATTTCG

GAGACGCTGTCGTCGATCGACGACATCGACTGGACATCCTTGTTTGAAAAGATGGAAATC

CAACTGAAGAATGGCGATAACAAGGACACGTTAATCAAAGAGCAGACGGAATACCGTAAA

GCTATCCACAAAAAGTTCGCTAATGACGACCGCTTTAAGAACATGTTCTCAGCAAAACTT

ATTAGCGATATTTTACCTGAATTTGTCATCCACAATAACAATTACTCCGCGAGTGAAAAA

GAGGAGAAAACCCAGGTGATTAAGCTGTTTTCCCGTTTTGCAACCAGTTTCAAGGACTAT

TTTAAGAATCGTGCTAATTGTTTCTCTGCAGACGACATTTCCTCGTCGTCCTGCCATCGC

ATTGTTAATGATAATGCTGAAATCTTTTTTTCAAACGCACTTGTGTATCGTCGCATTGTC

AAAAGCTTAAGTAATGACGATATCAATAAGATCTCAGGAGACATGAAGGACTCCCTGAAA

GAAATGTCATTGGAAGAAATTTACTCTTATGAAAAGTATGGAGAATTTATTACGCAGGAG

GGTATCAGCTTCTATAACGACATTTGTGGTAAAGTGAACAGCTTTATGAATCTTTATTGT

CAAAAGAATAAAGAGAACAAAAATCTGTACAAGCTGCAGAAATTGCATAAACAAATTCTG

TGCATTGCAGATACTTCGTATGAGGTTCCTTACAAATTCGAGTCGGATGAGGAGGTGTAT

CAAAGCGTAAACGGATTTTTGGATAACATTAGTAGTAAGCATATTGTGGAACGCCTTCGC

-continued

AAGATTGGTGACAACTATAACGGATACAACTTAGACAAGATCTATATTGTCTCGAAGTTT

TACGAAAGTGTTTCCCAAAAGACTTATCGCGACTGGGAGACAATCAACACTGCGCTGGAA

ATTCACTATAACAATATCTTGCCGGGGAACGGAAAAAGTAAGGCAGATAAGGTGAAGAAA

GCAGTCAAAAATGATCTGCAAAAAAGCATTACTGAAATTAACGAACTTGTGTCAAATTAC

AAATTGTGTTCGGATGACAATATTAAAGCGGAAACGTATATCCACGAGATCTCGCACATT

CTTAATAATTTCGAGGCGCAGGAATTAAAGTATAATCCTGAGATCCATTTGGTGGAATCA

GAACTTAAAGCTAGTGAACTGAAAAATGTCCTGGACGTTATTATGAATGCATTTCACTGG

TGTTCTGTCTTTATGACAGAAGAACTTGTCGACAAAGACAACAACTTTTATGCGGAATTA

GAAGAGATTTACGACGAAATTTATCCCGTTATTTCGTTATATAATTTAGTTCGTAATTAC

GTGACTCAGAAACCCTACAGCACAAAAAAGATTAAATTAAACTTTGGGATTCCGACTCTT

GCTGATGGATGGAGCAAGTCCAAGGAGTACTCTAATAACGCCATTATCTTGATGCGTGAC

AACCTGTACTACCTGGGCATTTTTAACGCTAAAAACAAACCCGACAAAAAGATCATTGAA

GGGAACACCTCGGAAAATAAGGGGGACTATAAAAAAATGATCTACAATCTGTTGCCAGGC

CCAAATAAGATGATCCCAAAGGTTTTTTTATCTTCCAAAACTGGCGTAGAAACTTACAAG

CCGAGCGCATACATCCTTGAAGGATATAAACAAAACAAACATATCAAAAGTTCAAAGGAC

TTCGATATTACGTTCTGCCATGATTTAATCGATTATTTCAAGAATTGCATCGCGATTCAC

CCAGAGTGGAAAAACTTTGGGTTTGATTTTTCAGACACCAGCACTTACGAGGATATTAGT

GGATTCTATCGTGAGGTTGAACTGCAGGGCTATAAAATTGACTGGACCTATATTTCTGAA

AAAGATATTGATCTGCTTCAGGAGAAAGGCCAATTGTACTTATTTCAAATCTATAACAAG

GATTTCTCCAAGAAGTCCACGGGTAATGACAACTTACACACAATGTATCTGAAGAATCTG

TTTAGTGAGGAGAACTTGAAGGACATTGTGCTGAAGCTTAATGGCGAGGCCGAAATCTTT

TTTCGTAAGTCCTCCATTAAAAACCCTATTATCCATAAGAAAGGGAGTATTCTTGTCAAC

CGCACGTATGAGGCCGAAGAAAAGGACCAATTCGGAAACATCCAAATTGTCCGTAAAAAT

ATTCCTGAGAACATTTACCAGGAGCTTTACAAGTATTTCAACGACAAGAGTGATAAAGAA

CTTTCAGATGAGGCGGCGAAACTGAAGAATGTAGTGGGGCACCACGAAGCTGCCACGAAT

ATTGTAAAGGATTACCGTTACACCTACGACAAGTACTTTTTGCATATGCCCATCACAATT

AATTTTAAGGCCAATAAAACTGGTTTTATCAACGATCGTATCTTACAGTACATTGCTAAG

GAAAAAGATCTGCACGTTATCGGTATCGATCGCGGGGAACGCAATCTGATTTATGTTAGT

GTGATTGACACGTGCGGAAATATTGTTGAGCAGAAGAGCTTTAATATCGTAAATGGATAT

GACTATCAAATTAAACTGAAGCAACAGGAAGGGGCCCGCCAGATTGCCCGCAAGGAGTGG

AAAGAAATTGGAAAGATCAAGGAGATTAAAGAAGGGTACCTTTCCCTTGTTATCCACGAA

ATCTCGAAAATGGTGATCAAGTACAATGCCATTATTGCTATGGAGGATCTGTCATATGGG

TTTAAGAAAGGCCGCTTTAAGGTGGAACGTCAGGTTTACCAGAAGTTTGAGACCATGCTT

ATCAATAAGCTGAATTATCTTGTCTTCAAAGACATCTCAATCACAGAGAACGGCGGGCTG

TTAAAAGGATATCAGCTGACCTATATCCCCGACAAACTGAAAAATGTCGGGCACCAATGC

GGCTGTATTTTCTACGTGCCCGCTGCATACACATCTAAAATTGACCCAACGACTGGATTC

GTAAATATTTTTAAGTTTAAGGATCTTACGGTAGATGCAAAGCGCGAATTTATCAAGAAA

TTTGATAGTATCCGTTACGACAGCGAGAAAAACTTATTTTGTTTTACGTTCGATTATAAC

AACTTCATCACGCAAAATACCGTCATGTCAAAATCTTCCTGGTCAGTCTATACGTATGGC

GTCCGTATCAAGCGCCGCTTCGTCAACGGGCGTTTTTCAAACGAGTCAGATACCATCGAT

ATCACCAAAGATATGGAAAAAACATTGGAGATGACGGACATCAATTGGCGCGATGGTCAT

-continued

GACTTACGCCAGGACATTATTGACTACGAAATCGTACAACATATTTTTGAGATTTTCCGT

CTGACCGTGCAAATGCGCAACTCATTATCCGAACTTGAGGATCGTGATTACGACCGCTTG

ATCAGTCCTGTTCTGAACGAGAATAATATTTTTTACGACAGTGCCAAGGCGGGAGACGCA

CTGCCCAAGGACGCTGACGCTAACGGAGCTTATTGTATTGCGTTGAAGGGACTTTACGAA

ATCAAGCAAATCACTGAAAACTGGAAGGAGGATGGTAAATTCTCACGCGACAAGTTGAAA

ATTTCGAACAAGGACTGGTTCGATTTCATCCAAAACAAGCGTTATTTAAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 89
CCAGCGGCTAAAAAAAAGAAACTGGATGGCAGCGTGGATATGAACAACGGGACTAATAAC

TTCCAGAACTTCATCGGTATTTCATCATTACAAAAAACGCTTCGTAACGCCTTGATCCCA

ACAGAAACGACCCAACAATTTATTGTAAAAAACGGCATCATCAAAGAAGACGAACTGCGT

GGCGAAAATCGCCAAATTTTGAAGGACATTATGGATGACTATTATCGTGGGTTTATCTCG

GAGACATTATCCTCCATCGACGACATTGATTGGACGAGTCTTTTTGAGAAAATGGAGATC

CAGCTTAAAAATGGTGATAACAAGGATACATTGATCAAGGAGCAAACCGAGTACCGCAAG

GCCATCCATAAGAAGTTCGCAAATGACGACCGCTTCAAAAATATGTTTAGTGCCAAATTG

ATCTCGGATATCCTTCCTGAGTTCGTAATTCACAACAATAATTATAGCGCATCCGAAAAG

GAGGAAAAGACTCAAGTCATTAAGCTTTTCAGTCGCTTTGCTACCTCGTTTAAGGACTAT

TTCAAGAACCGCGCGAACTGCTTCTCAGCGGATGACATTTCTTCCTCGTCGTGTCACCGC

ATCGTGAATGATAATGCGGAGATCTTCTTTAGTAATGCCTTGGTATACCGCCGCATTGTT

AAATCCCTGTCTAACGACGATATCAATAAGATCTCAGGAGATATGAAGGATAGCCTTAAA

GAAATGTCTCTGGAAGAAATTTACTCCTATGAAAAGTACGGTGAGTTTATCACCCAAGAG

GGGATTAGCTTTTATAACGATATCTGCGGGAAGGTGAATTCGTTTATGAACCTTTATTGT

CAAAAGAATAAGGAGAATAAGAACTTATATAAGCTTCAGAAACTGCATAAACAAATCTTA

TGCATTGCCGATACTAGCTATGAAGTTCCGTATAAATTCGAGAGCGATGAAGAAGTTTAT

CAGAGCGTCAATGGGTTCTTGGATAACATTTCATCAAAACACATCGTGGAACGTCTGCGT

AAGATTGGGGATAACTACAACGGATATAATCTTGACAAAATTTATATTGTATCTAAATTC

TATGAGTCGGTGAGTCAAAAGACCTACCGTGATTGGGAAACAATCAATACCGCGTTAGAA

ATCCACTATAACAACATTCTGCCAGGGAATGGTAAAAGTAAAGCGGACAAAGTCAAGAAG

GCTGTGAAGAACGATCTGCAAAAGAGTATTACAGAGATTAACGAATTAGTCTCCAATTAT

AAGTTATGCTCGGACGATAACATTAAGGCGGAGACGTATATTCATGAGATTTCGCATATT

CTTAACAACTTCGAGGCACAAGAGCTTAAGTATAACCCAGAGATTCACCTTGTCGAATCG

GAGCTGAAGGCATCGGAATTAAAAAATGTCTTAGATGTAATCATGAACGCGTTCCATTGG

TGCAGTGTTTTCATGACTGAGGAGTTAGTTGACAAGGACAATAACTTCTACGCAGAATTA

GAAGAGATCTATGATGAGATTTATCCAGTGATTTCGCTGTATAATCTGGTACGTAATTAC

GTCACTCAAAAGCCCTACTCAACAAAAAAAATTAAGCTGAACTTCGGAATTCCGACTCTG

GCCGACGGGTGGTCCAAGTCAAAGGAGTATTCTAATAATGCTATCATCCTGATGCGCGAT

AACTTATACTATTTGGGAATTTTCAATGCCAAAAATAAACCAGATAAAAAGATTATCGAA

GGTAATACAAGCGAGAATAAGGGTGACTATAAGAAAATGATTTACAATCTTCTTCCAGGC

CCTAACAAGATGATTCCCAAAGTTTTTTTGTCCAGTAAAACAGGGGTCGAAACTTACAAG

-continued

CCCAGTGCCTATATCCTTGAAGGGTACAAGCAGAATAAGCACATCAAATCCTCGAAAGAC

TTTGATATTACATTTTGTCATGACTTAATCGATTATTTTAAGAACTGTATCGCAATCCAT

CCAGAATGGAAGAACTTCGGGTTTGATTTCTCTGATACTTCCACGTATGAGGATATTTCC

GGGTTCTACCGCGAAGTAGAGCTTCAGGGCTATAAAATTGACTGGACATATATTTCAGAA

AAAGACATCGATCTGTTACAAGAAAAAGGACAGTTGTATCTGTTTCAAATCTATAATAAG

GATTTCTCCAAAAAGTCAACTGGAAATGATAACTTACATACAATGTATCTGAAAAATCTT

TTTAGTGAAGAGAATTTGAAGGATATCGTGCTGAAGTTAAATGGCGAAGCAGAGATCTTC

TTCCGCAAGTCCTCGATCAAGAATCCTATCATCCACAAGAAAGGTAGTATTCTGGTTAAC

CGCACGTACGAGGCCGAGGAAAAAGACCAGTTCGGTAATATCCAGATTGTACGTAAGAAT

ATTCCTGAAAATATTTACCAGGAATTATACAAGTATTTTAACGACAAATCGGATAAGGAG

CTTTCAGATGAGGCCGCAAAGTTGAAGAACGTCGTAGGACACCATGAGGCCGCTACGAAT

ATCGTCAAGGACTACCGCTATACGTATGACAAGTACTTCCTGCACATGCCTATTACTATC

AATTTCAAAGCTAATAAAACAGGATTCATCAATGATCGTATCCTTCAGTACATTGCCAAA

GAAAAAGATCTGCACGTAATCGGAATCGACCGTGGCGAACGTAATCTGATTTACGTATCA

GTTATCGACACATGTGGTAACATCGTGGAGCAGAAATCTTTTAACATTGTTAACGGCTAT

GATTATCAGATTAAGCTTAAACAGCAGGAGGGGGCACGCCAAATCGCTCGTAAAGAATGG

AAGGAGATTGGAAAGATTAAAGAGATTAAAGAGGGGTACCTTTCGCTGGTTATTCACGAA

ATTTCCAAGATGGTGATTAAGTACAATGCAATCATCGCGATGGAAGATCTTAGTTACGGA

TTCAAAAAGGGACGCTTCAAAGTTGAGCGTCAGGTCTACCAGAAATTTGAAACGATGCTG

ATTAACAAATTGAATTACTTGGTATTCAAAGATATCTCAATTACTGAAAATGGTGGCTTA

TTAAAGGGTTACCAGCTTACCTATATCCCGGATAAGCTGAAGAACGTGGGCCATCAATGC

GGCTGCATCTTTTACGTCCCTGCCGCATATACCTCTAAAATTGACCCCACCACCGGATTC

GTAAATATTTTTAAATTCAAGGACCTGACGGTGGACGCCAAGCGCGAATTCATCAAAAAA

TTCGACTCAATCCGCTATGATTCCGAAAAAAATCTTTTCTGCTTTACGTTCGATTATAAT

AACTTCATTACCCAAAACACGGTGATGTCAAAATCGTCCTGGAGCGTGTATACTTATGGA

GTGCGTATCAAGCGCCGCTTTGTTAATGGGCGCTTCAGTAACGAAAGCGATACCATCGAC

ATTACCAAAGACATGGAGAAGACGCTTGAAATGACGGATATCAATTGGCGTGACGGACAC

GATCTTCGTCAGGATATCATCGACTACGAGATTGTGCAACATATCTTTGAGATTTTCCGT

TTAACTGTTCAAATGCGTAACTCCTTGTCCGAATTGGAAGACCGTGATTACGACCGCTTG

ATTTCACCAGTGCTTAACGAGAATAACATCTTCTACGACTCCGCCAAAGCAGGCGATGCC

CTGCCAAAGGACGCTGATGCAAATGGTGCATACTGTATCGCGTTGAAGGGCTTATACGAG

ATTAAGCAAATCACCGAAAATTGGAAAGAGGATGGAAAGTTCAGTCGCGATAAGCTGAAG

ATCTCTAATAAAGATTGGTTTGACTTTATCCAGAACAAACGTTATTTAAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 90

CCAGCGGCTAAAAAAAAGAAACTGGATGGCAGCGTGGATATGAACAACGGTACCAATAAT

TTCCAAAATTTCATCGGAATCTCATCCTTGCAAAAAACCTTGCGCAATGCTTTGATCCCC

ACCGAAACCACGCAGCAGTTCATCGTGAAAAACGGCATTATCAAAGAGGATGAGTTGCGC

GGGGAAAACCGTCAAATTCTTAAGGATATCATGGACGATTACTACCGTGGGTTTATCAGT

GAGACCCTGTCAAGCATTGACGACATTGACTGGACCAGCTTATTTGAGAAGATGGAGATT

-continued

CAATTAAAGAACGGGGACAATAAGGACACGCTTATCAAAGAGCAGACAGAATACCGTAAA
GCGATTCATAAGAAATTTGCAAATGACGATCGCTTCAAGAACATGTTTTCAGCAAAATTA
ATCAGCGACATCCTTCCCGAATTTGTGATTCATAATAACAACTATTCGGCTAGCGAAAAA
GAGGAGAAAACTCAGGTTATTAAGCTTTTCTCGCGTTTTGCCACTTCGTTCAAAGACTAT
TTTAAGAATCGCGCAAACTGCTTTTCGGCTGATGATATTTCCAGTTCTAGCTGCCATCGT
ATCGTTAACGATAATGCTGAGATTTTCTTCTCTAATGCCCTGGTGTATCGTCGTATCGTT
AAATCTTTGAGCAACGACGATATTAATAAGATTTCAGGCGACATGAAGGATTCTTTAAAG
GAGATGTCTTTAGAAGAGATTTATTCCTATGAGAAATATGGCGAGTTTATCACCCAAGAA
GGAATTTCGTTCTACAACGACATCTGTGGCAAAGTGAACAGCTTCATGAATTTATACTGC
CAAAAGAATAAGGAGAATAAAAATTTATATAAACTGCAGAAACTGCATAAGCAAATTCTT
TGCATTGCAGACACCTCTTATGAAGTTCCTTATAAGTTTGAATCGGACGAGGAGGTATAT
CAGAGTGTGAACGGGTTCCTGGACAATATTTCATCCAAGCATATTGTTGAACGTTTACGC
AAAATTGGAGACAATTACAATGGGTATAACCTTGACAAAATTTACATCGTGTCGAAGTTT
TACGAATCGGTAAGCCAGAAGACCTATCGTGACTGGGAAACTATCAATACCGCCTTAGAA
ATTCATTACAACAATATTCTTCCTGGTAACGGCAAAAGCAAAGCCGATAAGGTAAAGAAG
GCTGTCAAGAACGACCTGCAAAAGTCTATCACAGAGATCAACGAGTTAGTCTCTAACTAC
AAATTATGTTCCGACGACAATATTAAAGCCGAAACCTACATCCATGAGATCTCACACATT
CTTAACAATTTTGAGGCCCAGGAGCTGAAATATAACCCAGAAATTCACCTTGTAGAGAGC
GAATTAAAAGCCTCCGAGCTGAAGAACGTTTTGGATGTAATCATGAACGCATTTCATTGG
TGCAGCGTATTTATGACAGAGGAGTTGGTCGACAAGGACAATAACTTTTACGCCGAGCTT
GAAGAAATCTACGATGAAATTTACCCGGTAATTAGTTTATATAATTTAGTTCGCAACTAC
GTAACTCAGAAACCCTACAGTACCAAGAAGATTAAATTGAACTTTGGGATCCCGACACTT
GCTGACGGTTGGAGTAAATCAAAAGAATACTCCAATAATGCAATTATCCTGATGCGCGAC
AATCTTTACTACTTGGGGATCTTTAACGCAAAGAACAAACCAGATAAGAAAATCATCGAG
GGCAACACCAGCGAGAATAAAGGCGATTACAAGAAAATGATCTATAATCTTTTGCCGGGA
CCGAACAAAATGATCCCAAAGGTTTTCCTGTCGTCGAAAACGGGAGTCGAGACATATAAA
CCATCTGCGTACATCTTGGAAGGTTACAAACAGAATAAGCATATTAAGTCTAGTAAAGAC
TTCGACATCACCTTTTGTCATGACCTGATTGATTATTTCAAGAACTGTATTGCTATCCAT
CCAGAATGGAAAAACTTCGGATTTGACTTCTCCGATACTAGCACCTACGAAGACATTTCG
GGTTTTTATCGCGAAGTAGAGCTTCAAGGGTACAAAATTGATTGGACATATATTAGCGAG
AAAGACATTGATTTGCTTCAAGAGAAGGGACAGTTATATTTATTCCAGATCTACAACAAA
GACTTCTCGAAGAAATCCACCGGTAATGATAATCTTCACACTATGTACCTGAAGAATTTA
TTTTCAGAGGAAAATCTGAAGGACATTGTACTTAAACTTAATGGAGAAGCCGAAATCTTC
TTCCGCAAGAGTTCCATTAAAAATCCGATTATTCATAAAAAGGGAAGTATCCTTGTGAAC
CGCACGTATGAGGCCGAAGAGAAGGATCAGTTTGGGAATATTCAAATTGTCCGCAAAAAC
ATCCCCGAGAACATCTACCAGGAACTGTATAAATACTTTAATGATAAATCTGATAAAGAG
TTATCAGACGAGGCTGCCAAACTGAAAAACGTAGTCGGTCATCATGAGGCAGCGACCAAT
ATTGTAAAGGACTACCGTTACACCTACGACAAGTATTTCCTTCACATGCCGATCACGATT
AATTTTAAGGCTAACAAGACCGGCTTTATCAATGACCGCATCTTGCAGTACATCGCGAAA
GAGAAAGATTTACACGTCATCGGAATTGATCGTGGAGAGCGTAATCTTATCTACGTCAGC

-continued

GTCATCGACACCTGTGGAAACATTGTGGAACAAAAAAGTTTTAATATCGTAAACGGCTAC

GACTATCAAATTAAACTTAAACAGCAAGAGGGAGCTCGCCAGATCGCTCGCAAAGAGTGG

AAAGAGATTGGGAAAATTAAAGAAATTAAAGAGGGTTACCTGTCGCTGGTAATTCACGAA

ATCTCGAAAATGGTCATCAAATATAATGCAATTATCGCTATGGAGGATCTGTCCTACGGG

TTCAAGAAGGGACGTTTTAAAGTAGAGCGCCAGGTGTATCAAAAATTCGAAACCATGTTG

ATCAATAAGCTTAACTATTTGGTCTTCAAAGATATTTCGATTACGGAGAACGGAGGTTTG

TTGAAAGGATATCAGCTGACGTATATCCCAGACAAGTTGAAAAACGTGGGGCATCAATGT

GGATGTATTTTCTATGTGCCCGCGGCCTACACGAGTAAGATCGATCCTACCACTGGTTTC

GTCAACATTTTCAAATTTAAAGATCTTACCGTGGATGCGAAGCGCGAATTTATTAAGAAA

TTTGATAGCATTCGCTATGATTCCGAAAAGAACCTGTTCTGTTTTACGTTCGACTATAAC

AATTTCATTACCCAAAACACGGTGATGAGCAAATCCTCTTGGTCAGTTTATACATACGGT

GTACGTATCAAACGCCGTTTCGTTAACGGACGCTTTTCCAATGAGTCTGATACAATCGAT

ATCACGAAAGATATGGAAAAAACATTAGAGATGACTGATATCAACTGGCGTGACGGGCAC

GACCTGCGTCAAGACATTATTGACTACGAGATTGTGCAGCATATCTTCGAAATCTTTCGC

TTAACTGTGCAAATGCGTAACTCGTTATCCGAGTTAGAAGACCGTGACTACGATCGCCTG

ATTTCACCCGTCTTGAACGAAAATAACATCTTCTACGATTCCGCGAAGGCTGGGGACGCA

TTGCCCAAGGACGCAGACGCGAATGGAGCGTACTGTATTGCGCTTAAAGGATTATATGAA

ATCAAGCAGATCACCGAAAATTGGAAGGAGGACGGGAAGTTCTCACGCGACAAACTGAAG

ATTTCAAATAAGGACTGGTTCGATTTCATTCAGAATAAGCGTTACCTGAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 91
CCAGCGGCTAAAAAAAAGAAACTGGATGGCAGCGTGGATATGAATAATGGTACGAACAAC

TTTCAGAACTTCATCGGCATCTCCAGCCTTCAAAAGACTTTACGCAACGCATTGATTCCC

ACGGAGACTACGCAACAGTTTATCGTAAAAAATGGTATTATCAAAGAAGATGAATTACGC

GGGGAGAATCGCCAGATTCTTAAGGACATTATGGACGATTATTACCGTGGATTCATCAGT

GAGACACTGAGCTCCATTGATGACATCGACTGGACGTCATTGTTTGAAAAGATGGAAATC

CAGTTGAAAAATGGCGATAACAAAGATACATTGATTAAAGAGCAGACAGAGTACCGCAAA

GCAATTCACAAGAAATTCGCCAATGATGATCGTTTTAAGAACATGTTTAGTGCCAAGCTT

ATTTCGGATATCTTACCCGAATTCGTGATTCACAACAACAATTATTCGGCAAGTGAGAAA

GAGGAAAAGACCCAGGTTATCAAATTGTTTTCGCGCTTCGCCACTTCGTTCAAAGATTAT

TTCAAGAACCGTGCAAACTGTTTCTCCGCTGACGACATCAGTTCCAGCTCATGCCACCGT

ATTGTAAATGACAATGCGGAGATCTTTTTCAGTAATGCCTTAGTATATCGTCGCATTGTA

AAGAGCTTATCTAATGATGACATTAACAAGATCTCGGGTGATATGAAGGACTCACTTAAG

GAGATGAGTCTGGAAGAGATCTACTCCTACGAAAAATACGGGGAATTCATCACCCAGGAG

GGAATTTCATTCTACAACGATATCTGCGGCAAAGTTAACTCCTTTATGAATCTGTACTGT

CAAAAGAACAAGGAGAATAAAAACCTGTATAAATTGCAGAAACTTCATAAACAAATTTTG

TGTATCGCAGACACGAGTTATGAAGTACCTTATAAATTCGAATCCGACGAAGAGGTATAT

CAGTCCGTAAATGGGTTCCTGGACAATATCAGTAGTAAGCACATTGTGGAACGCTTACGC

AAAATTGGAGACAATTACAACGGGTATAACCTGGACAAAATCTACATCGTATCCAAATTT

TATGAAAGCGTGTCTCAAAAAACTTATCGTGATTGGGAAACAATCAACACGGCTCTTGAG

-continued

ATCCATTACAATAACATCTTGCCGGGTAACGGCAAATCGAAGGCAGACAAAGTTAAAAAA

GCAGTTAAGAACGACTTACAGAAAAGCATTACGGAGATTAACGAGTTAGTAAGTAATTAC

AAATTATGCTCCGACGATAATATCAAAGCTGAAACCTACATCCATGAAATTAGCCACATT

TTGAACAATTTCGAAGCGCAGGAGCTGAAATATAACCCTGAAATCCATCTGGTAGAGTCT

GAGTTGAAGGCGTCAGAACTGAAAAACGTTCTTGACGTCATCATGAATGCCTTTCACTGG

TGTAGTGTTTTTATGACTGAGGAGCTTGTAGATAAGGACAACAACTTCTATGCTGAACTT

GAAGAGATCTACGATGAAATCTACCCCGTAATCAGTCTGTATAATTTAGTTCGTAACTAC

GTCACGCAGAAACCCTATTCGACTAAGAAAATTAAGCTGAACTTTGGGATCCCTACTTTG

GCAGACGGGTGGAGCAAGAGTAAAGAATACAGTAATAATGCAATTATCTTGATGCGCGAT

AACTTATATTACTTAGGTATTTTCAATGCTAAGAACAAACCTGATAAGAAGATTATCGAA

GGAAATACGAGTGAGAATAAGGGAGACTACAAAAAGATGATTTACAACTTGCTGCCAGGG

CCTAATAAGATGATTCCAAAAGTTTTTCTGTCGAGCAAGACAGGGGTTGAAACTTATAAG

CCATCCGCTTATATCCTTGAGGGGTACAAGCAGAATAAGCATATCAAGTCCTCCAAAGAT

TTTGATATTACATTTTGCCACGACTTAATTGATTACTTCAAGAACTGCATCGCAATCCAT

CCCGAATGGAAGAATTTCGGCTTCGATTTCTCAGATACGTCCACGTATGAGGATATCTCA

GGCTTTTACCGCGAAGTTGAGCTGCAAGGTTATAAAATTGATTGGACATACATCTCCGAA

AAAGACATTGATCTTTTACAGGAAAAGGGCCAATTATACTTATTTCAAATCTATAACAAA

GATTTTAGCAAGAAGTCCACAGGTAATGATAACCTGCATACGATGTATTTGAAAAATCTT

TTCAGTGAAGAGAATTTGAAGGATATCGTCCTGAAGCTGAACGGTGAGGCTGAGATCTTC

TTCCGCAAATCGTCTATCAAAAACCCCATCATTCACAAAAAGGGAAGTATCTTAGTAAAC

CGCACTTATGAAGCGGAGGAAAAGGATCAGTTCGGGAACATCCAGATCGTGCGCAAGAAC

ATTCCAGAAAACATCTATCAGGAACTTTACAAATATTTCAATGACAAGTCTGATAAAGAA

TTATCAGACGAGGCGGCGAAACTTAAAAATGTTGTTGGACACCACGAAGCAGCGACGAAT

ATTGTAAAGGATTATCGCTACACATACGATAAATACTTTTTGCACATGCCAATCACCATT

AACTTTAAGGCGAACAAGACAGGTTTCATTAACGACCGTATTCTGCAATATATCGCAAAG

GAAAAAGACCTGCACGTTATTGGGATCGATCGTGGCGAACGCAATTTGATCTACGTAAGC

GTTATCGACACTTGCGGAAATATCGTTGAACAAAAAAGCTTTAATATCGTCAATGGATAC

GATTACCAAATCAAGCTGAAACAACAAGAAGGGGCACGTCAGATCGCTCGTAAAGAATGG

AAAGAGATTGGTAAGATCAAAGAGATTAAAGAAGGGTATCTTTCTTTAGTAATTCACGAG

ATTTCGAAAATGGTTATTAAATACAATGCGATTATTGCTATGGAAGACTTAAGCTACGGC

TTTAAGAAAGGTCGCTTCAAAGTGGAGCGCCAAGTGTATCAGAAGTTTGAAACGATGTTG

ATTAACAAATTAAATTACCTGGTCTTTAAGGACATCAGTATCACAGAAAATGGGGGGTTG

CTTAAAGGGTACCAGCTTACATACATCCCTGATAAACTGAAAAATGTCGGTCATCAGTGC

GGATGTATCTTCTATGTACCAGCAGCCTATACCAGTAAGATTGACCCTACTACTGGCTTT

GTGAATATTTTTAAATTCAAGGATTTAACCGTGGACGCCAAGCGTGAATTTATTAAAAAA

TTTGATTCGATTCGCTACGACAGTGAGAAAAACCTTTTCTGCTTTACCTTTGACTACAAC

AATTTTATTACCCAGAACACCGTAATGTCAAAGAGTTCGTGGTCTGTATATACCTACGGT

GTTCGCATCAAGCGCCGCTTCGTAAACGGGCGTTTCAGTAACGAATCTGACACCATCGAC

ATCACTAAAGATATGGAGAAGACATTGGAAATGACGGACATTAATTGGCGTGATGGCCAT

GACTTACGTCAGGACATTATTGATTACGAAATTGTGCAGCATATCTTCGAGATTTTCCGT

TTGACAGTTCAGATGCGCAACTCACTGAGTGAGTTAGAAGATCGCGATTACGACCGTCTG

ATCTCACCGGTCCTTAATGAAAACAACATTTTCTACGACTCAGCAAAGGCGGGTGATGCC

CTGCCAAAGGATGCGGACGCTAATGGCGCCTACTGCATCGCCCTGAAAGGATTGTATGAA

ATTAAGCAGATTACAGAAAATTGGAAGGAAGATGGTAAATTTAGCCGTGATAAATTAAAA

ATCTCGAACAAGGATTGGTTCGATTTTATTCAGAACAAACGTTATTTGAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 92

CCAGCGGCTAAAAAAAAGAAACTGGATGGCAGCGTGGATATGAACAATGGAACAAATAAT

TTTCAAAATTTTATCGGCATCTCAAGTCTTCAAAAAACCCTTCGCAATGCCCTGATTCCA

ACTGAAACAACCCAGCAATTTATCGTCAAGAACGGCATCATTAAGGAAGACGAGTTACGC

GGGGAGAACCGTCAAATCCTGAAAGATATCATGGATGACTACTATCGTGGGTTCATTTCG

GAAACCTTGTCTTCAATCGACGACATTGACTGGACGAGTCTTTTCGAGAAAATGGAAATT

CAGCTTAAAAATGGAGACAACAAGGATACTCTGATTAAGGAACAGACAGAATATCGCAAA

GCTATCCACAAAAAAGTTCGCTAATGATGATCGTTTCAAAAATATGTTTTCTGCTAAATTG

ATTTCCGATATCTTGCCTGAATTTGTAATCCACAACAACAATTATTCTGCTTCCGAGAAG

GAAGAGAAGACCCAGGTCATTAAATTATTCAGCCGCTTTGCAACCAGCTTTAAAGACTAC

TTTAAGAATCGCGCTAACTGCTTTTCGGCGGATGACATCTCATCATCATCATGCCACCGC

ATTGTGAACGACAATGCGGAGATCTTCTTTTCGAATGCGTTAGTTTATCGTCGCATTGTC

AAAAGTCTTAGCAATGATGACATCAACAAGATCTCAGGAGACATGAAAGATTCCTTAAAG

GAGATGTCTCTTGAGGAAATCTATTCGTATGAGAAATACGGCGAGTTCATTACCCAGGAA

GGTATTAGTTTCTACAATGATATCTGCGGCAAAGTAAATTCTTTTATGAATCTGTATTGC

CAAAAAAACAAAGAAAACAAGAATCTTTATAAGTTACAAAAGTTACATAAGCAAATTCTG

TGCATCGCTGATACATCTTATGAGGTACCCTACAAATTTGAAAGTGATGAGGAGGTCTAT

CAGAGTGTCAACGGCTTCTTAGACAACATCTCTTCCAAACATATCGTGGAACGCCTGCGT

AAAATCGGAGATAACTACAACGGATATAACTTAGATAAAATCTACATCGTGTCCAAGTTT

TATGAAAGTGTGAGCCAAAAAACATATCGTGACTGGGAAACCATTAACACCGCATTGGAA

ATTCACTATAACAACATTTTGCCAGGCAACGGGAAAAGTAAGGCGGACAAAGTTAAGAAA

GCAGTTAAAAATGACCTGCAAAAAAGCATCACTGAAATTAACGAATTGGTATCGAATTAC

AAATTATGTAGCGACGATAATATCAAAGCAGAAACTTACATTCACGAGATTAGTCACATT

TTAAATAACTTCGAGGCCCAGGAATTGAAATACAATCCCGAAATTCATTTGGTTGAATCA

GAACTGAAAGCATCAGAGTTGAAAAATGTGTTAGATGTCATTATGAATGCGTTTCATTGG

TGCTCTGTGTTCATGACCGAGGAACTGGTTGATAAAGATAACAACTTTTACGCTGAATTG

GAGGAGATTTACGATGAGATTTACCCGGTCATTTCGCTTTATAACTTAGTGCGCAATTAT

GTGACGCAGAAACCATATTCCACGAAGAAAATCAAACTTAATTTTGGCATCCCTACTCTG

GCTGATGGTTGGTCGAAATCGAAAGAGTACAGCAACAACGCGATCATTCTTATGCGTGAC

AATCTTTACTATTTGGGCATTTTTAATGCCAAGAATAAGCCAGATAAGAAAATCATTGAG

GGGAATACTTCCGAGAATAAGGGGGATTACAAAAAGATGATCTATAACTTGCTGCCCGGC

CCCAACAAAATGATTCCTAAGGTTTTCTTGTCAAGCAAGACGGGCGTCGAAACATATAAG

CCGTCAGCTTATATTCTGGAAGGCTATAAACAGAATAAGCACATCAAGTCTTCCAAGGAC

TTTGACATCACTTTTTGCCACGATTTGATCGACTACTTTAAGAACTGTATTGCGATTCAT

-continued

CCGGAATGGAAGAACTTCGGTTTCGACTTTTCCGATACCTCAACATACGAGGATATCAGC

GGCTTCTACCGTGAAGTCGAGCTTCAAGGCTACAAGATCGATTGGACATATATTTCAGAG

AAGGACATTGATTTGTTACAAGAGAAAGGTCAACTTTACTTATTTCAGATCTATAACAAA

GACTTTTCGAAGAAATCGACAGGAAACGATAACTTACACACTATGTATTTAAAAAATCTG

TTTTCGGAGGAAAACCTGAAAGATATTGTGCTGAAACTTAACGGCGAGGCAGAGATCTTT

TTCCGTAAAAGCTCAATCAAGAATCCTATCATCCATAAAAAAGGTAGTATTCTTGTCAAC

CGCACATATGAAGCGGAGGAGAAGGACCAATTCGGAAACATCCAAATTGTCCGTAAGAAT

ATTCCGGAGAACATTTACCAAGAGTTGTATAAATACTTTAACGATAAGTCAGATAAGGAA

CTTAGCGATGAGGCGGCGAAGCTTAAAAACGTAGTTGGGCATCATGAAGCTGCTACCAAC

ATTGTAAAAGATTACCGTTACACCTATGACAAGTATTTCTTGCACATGCCCATTACGATC

AATTTCAAAGCAAATAAGACAGGCTTTATCAATGATCGCATCCTGCAGTACATTGCTAAA

GAGAAGGATTTGCATGTTATCGGTATTGATCGCGGAGAGCGCAATTTGATCTACGTCTCC

GTAATCGACACTTGCGGTAACATTGTTGAGCAGAAGTCGTTCAACATCGTTAATGGTTAT

GATTACCAAATCAAGCTGAAGCAGCAAGAGGGTGCCCGCCAGATCGCGCGTAAGGAATGG

AAAGAAATCGGGAAAATTAAAGAGATCAAAGAAGGCTATTTGTCTCTGGTAATTCACGAA

ATCAGCAAGATGGTGATCAAGTATAACGCGATCATTGCGATGGAGGATCTTTCTTATGGC

TTCAAGAAAGGGCGCTTTAAAGTCGAACGCCAGGTCTACCAGAAATTTGAGACAATGCTT

ATCAACAAGCTTAACTATCTTGTATTTAAGGATATTTCCATCACTGAGAACGGAGGACTT

TTAAAGGGGTACCAACTGACGTACATTCCTGATAAGCTGAAGAACGTTGGTCATCAATGC

GGATGCATCTTCTATGTGCCAGCGGCTTACACCTCCAAAATCGATCCCACTACAGGCTTT

GTCAATATCTTCAAATTCAAGGATTTGACCGTTGACGCGAAGCGCGAGTTTATCAAGAAG

TTTGATAGCATTCGCTACGACAGCGAAAAAAATTTATTTTGTTTTACTTTCGACTACAAT

AACTTTATTACTCAGAACACTGTCATGTCAAAGAGTTCGTGGAGTGTCTACACGTACGGA

GTACGTATTAAGCGCCGTTTCGTCAACGGACGCTTCTCAAACGAAAGCGACACGATCGAC

ATCACCAAAGACATGGAAAAAACTCTTGAGATGACGGATATCAATTGGCGCGACGGCCAT

GACCTGCGTCAGGATATCATTGATTACGAGATCGTTCAGCACATCTTCGAAATCTTCCGC

CTTACCGTCCAGATGCGCAACAGTTTAAGCGAGCTTGAAGACCGCGACTACGATCGTTTG

ATTAGCCCCGTTCTGAACGAGAATAATATTTTCTACGACAGCGCAAAGGCCGGTGATGCT

TTGCCAAAGGACGCAGACGCGAATGGAGCCTACTGCATCGCCCTGAAGGGCTTATATGAG

ATTAAGCAAATTACCGAAAATTGGAAGGAAGATGGTAAGTTCTCCCGTGATAAGCTTAAA

ATTAGCAATAAGGATTGGTTCGACTTCATCCAGAACAAACGTTACCTGAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 93
CCAGCGGCTAAAAAAAAGAAACTGGATGGCAGCGTGGATATGAACAACGGAACAAACAAT

TTCCAAAACTTCATCGGTATCTCTTCGTTGCAGAAGACTCTGCGTAATGCTTTGATCCCG

ACGGAGACAACCCAACAATTTATCGTCAAAAACGGTATTATTAAGGAGGACGAGTTACGT

GGAGAAAATCGTCAAATCCTTAAGGACATCATGGACGATTATTATCGCGGGTTTATTTCT

GAAACCCTGAGCAGTATCGATGATATCGACTGGACCTCACTTTTTGAGAAAATGGAGATC

CAGTTGAAGAACGGTGATAACAAAGACACTCTGATCAAAGAGCAAACTGAATACCGCAAG

-continued

GCAATTCACAAAAAGTTCGCCAACGACGACCGTTTCAAGAATATGTTCTCAGCTAAGTTA

ATCAGCGACATTTTGCCAGAGTTCGTTATCCACAACAATAATTATAGTGCTTCAGAGAAG

GAGGAAAAAAACCCAAGTGATTAAACTTTTTTCGCGCTTTGCAACCTCATTCAAGGACTAC

TTCAAGAATCGCGCGAATTGCTTCAGTGCGGACGACATTTCTTCTTCAAGTTGCCATCGT

ATCGTTAACGATAACGCGGAAATTTTCTTCTCTAATGCTTTGGTGTATCGCCGCATTGTA

AAATCGCTTAGTAACGATGACATTAATAAGATCTCAGGTGATATGAAAGATTCATTGAAG

GAAATGAGCTTGGAAGAGATTTACAGTTACGAAAAATATGGAGAATTTATTACTCAGGAA

GGCATCTCATTCTATAACGATATCTGCGGGAAGGTAAATTCGTTTATGAACTTATATTGC

CAGAAAAATAAAGAGAATAAAAATTTGTATAAGCTTCAGAAGTTGCACAAACAGATCCTG

TGCATTGCAGACACCTCGTATGAGGTTCCGTATAAATTTGAGTCCGATGAAGAAGTGTAT

CAGTCTGTGAATGGTTTCTTAGATAATATCTCTTCCAAGCATATTGTCGAACGCCTGCGC

AAAATTGGTGATAACTATAACGGATACAATCTGGATAAAATTTACATCGTTTCTAAATTT

TACGAGTCAGTCTCGCAGAAGACCTACCGCGACTGGGAAACAATTAACACGGCATTGGAG

ATTCACTACAATAATATCTTGCCTGGTAACGGTAAGTCTAAGGCAGATAAGGTAAAAAAA

GCTGTGAAAAACGACCTTCAGAAAAGCATCACGGAGATTAATGAGCTGGTGAGTAATTAC

AAATTATGTTCAGACGATAATATTAAAGCTGAAACGTATATCCATGAAATCTCGCATATC

TTGAACAACTTCGAGGCCCAAGAACTTAAATATAACCCCGAAATCCATTTAGTCGAGTCT

GAATTGAAAGCGTCGGAATTAAAAAACGTCTTAGACGTCATTATGAACGCGTTTCACTGG

TGTTCAGTTTTCATGACCGAAGAGCTGGTCGACAAAGACAACAACTTCTATGCGGAATTG

GAGGAAATCTATGATGAAATCTACCCTGTTATTTCACTGTATAACCTTGTGCGCAACTAT

GTCACTCAGAAGCCGTATTCGACCAAAAAAATTAAATTGAATTTCGGTATCCCTACTCTT

GCAGACGGATGGAGTAAAAGCAAGGAATACAGTAATAACGCCATTATTCTTATGCGCGAC

AATTTATACTACCTGGGCATCTTTAACGCAAAGAATAAGCCGGATAAGAAGATTATTGAG

GGTAACACCAGTGAGAACAAGGGCGACTATAAGAAGATGATCTATAACTTATTGCCAGGT

CCAAATAAAATGATCCCAAAAGTATTCTTATCATCAAAGACGGGAGTTGAAACCTATAAG

CCTAGTGCCTATATTCTTGAGGGATATAAACAGAACAAGCACATTAAGTCGTCTAAGGAT

TTTGACATTACGTTCTGCCATGACTTAATCGACTATTTTAAAAACTGTATTGCGATTCAC

CCCGAATGGAAGAATTTTGGATTCGATTTTTCGGATACCTCGACCTATGAAGATATTTCG

GGATTTTATCGTGAAGTGGAGTTGCAAGGCTATAAAATCGATTGGACCTATATCTCAGAA

AAAGACATTGATTTATTACAGGAAAAGGGACAACTGTACCTTTTCCAAATTTATAACAAG

GACTTTTCTAAAAAGTCCACAGGAAATGATAACCTTCACACCATGTACCTGAAGAACCTT

TTCTCAGAGGAAAACCTGAAGGACATTGTCCTTAAGTTAAATGGAGAAGCGGAGATCTTT

TTCCGTAAATCTAGTATCAAGAATCCGATTATCCATAAAAAAGGTTCGATTTTGGTAAAT

CGCACCTATGAAGCGGAAGAGAAAGATCAATTTGGTAACATCCAGATCGTGCGCAAGAAT

ATCCCGGAGAACATTTACCAAGAGCTGTATAAGTACTTCAATGATAAGTCTGATAAGGAA

CTGTCAGATGAAGCTGCGAAATTGAAGAACGTGGTTGGGCATCATGAAGCCGCTACCAAT

ATCGTCAAGGATTACCGTTATACCTATGACAAATATTTCTTACACATGCCGATTACGATC

AATTTTAAGGCAAACAAGACAGGATTCATCAACGACCGTATCTTGCAGTATATTGCCAAA

GAGAAGGATCTGCATGTGATCGGTATTGACCGCGGGGAGCGCAATTTAATCTATGTATCG

GTGATCGATACTTGTGGTAACATCGTAGAACAAAAGAGCTTTAACATCGTGAATGGTTAC

GACTATCAGATCAAGCTGAAACAACAGGAAGGAGCCCGCCAGATCGCTCGCAAGGAATGG

-continued

AAAGAAATCGGGAAAATTAAGGAAATCAAGGAAGGCTACCTTTCATTGGTCATTCACGAA

ATTTCGAAAATGGTAATTAAGTACAACGCGATCATCGCCATGGAGGACCTTTCGTACGGA

TTTAAGAAGGGTCGTTTCAAAGTTGAGCGCCAGGTATACCAAAAATTCGAGACTATGCTT

ATCAACAAACTTAACTACTTGGTCTTTAAGGACATTTCTATTACCGAAAACGGCGGCTTA

CTTAAAGGCTATCAATTGACATATATTCCCGACAAACTGAAGAATGTTGGACATCAATGC

GGGTGTATTTTCTATGTGCCGGCAGCTTACACTAGTAAGATCGACCCTACAACCGGGTTC

GTAAACATTTTTAAATTCAAAGACTTAACAGTCGATGCGAAGCGTGAATTTATTAAGAAG

TTTGATAGTATCCGCTATGACAGTGAAAAGAACTTGTTTTGCTTTACGTTCGACTACAAT

AACTTTATTACACAGAACACGGTCATGTCTAAATCATCATGGTCGGTTTACACATATGGG

GTGCGCATCAAGCGTCGCTTTGTAAATGGCCGTTTTAGTAATGAGAGCGACACAATCGAC

ATCACAAAGGATATGGAGAAAACTCTTGAGATGACAGACATCAATTGGCGTGACGGTCAT

GACTTACGCCAAGATATCATCGACTACGAAATCGTACAGCATATTTTTGAGATTTTTCGT

CTTACTGTGCAAATGCGTAATTCTTTATCCGAACTGGAAGATCGTGATTACGACCGCTTG

ATTAGTCCCGTCTTAAATGAGAACAATATTTTCTATGATTCTGCGAAAGCCGGAGATGCA

CTGCCCAAAGACGCTGATGCCAATGGCGCGTATTGCATTGCATTAAAAGGATTATATGAG

ATTAAACAGATTACCGAAAATTGGAAAGAGGACGGTAAATTCTCACGCGATAAATTGAAG

ATTTCTAACAAGGACTGGTTCGACTTTATCCAAAATAAACGTTATCTTAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 94

CCAGCGGCTAAAAAAAAGAAACTGGATGGCAGCGTGGATATGAATAACGGTACCAACAAC

TTTCAGAATTTCATTGGCATTAGCTCGCTTCAAAAAACTTTACGCAATGCTCTTATTCCG

ACTGAGACGACACAACAGTTTATCGTTAAGAATGGCATCATCAAAGAAGATGAATTACGC

GGAGAAAACCGCCAGATCCTGAAAGACATTATGGACGATTATTACCGTGGGTTCATCTCC

GAGACGTTGTCATCGATCGATGACATCGACTGGACGTCACTTTTTGAAAAAATGGAGATC

CAGTTAAAGAACGGTGACAATAAGGATACATTGATCAAAGAACAGACCGAGTACCGTAAA

GCGATTCATAAAAAGTTTGCGAACGATGATCGCTTCAAGAATATGTTTTCTGCGAAATTA

ATTTCCGACATTTTACCTGAATTTGTTATTCATAATAACAACTACTCGGCGTCTGAGAAA

GAGGAGAAAACCCAAGTGATTAAACTTTTTTCACGTTTCGCAACGTCGTTCAAAGACTAT

TTTAAAAATCGTGCTAATTGCTTTAGCGCGGATGACATCAGCTCTAGTTCATGTCATCGC

ATTGTCAACGATAATGCTGAGATCTTTTTCAGTAATGCGTTAGTGTACCGTCGTATTGTG

AAGTCCTTATCTAATGATGATATCAATAAGATCAGCGGGGATATGAAGGACTCACTTAAG

GAGATGAGCTTGGAGGAAATCTATTCCTATGAGAAGTATGGTGAGTTTATTACGCAAGAA

GGAATTAGCTTTTACAACGATATCTGTGGAAAGGTGAATTCGTTTATGAATTTGTATTGC

CAGAAAAATAAGGAGAACAAGAACCTTTATAAATTGCAAAAGTTACACAAGCAAATCCTG

TGCATTGCAGATACTTCCTACGAGGTGCCTTACAAGTTTGAATCCGACGAAGAGGTCTAC

CAATCTGTAAACGGTTTCTTAGATAATATTAGTTCCAAGCATATTGTGGAGCGCCTTCGT

AAAATTGGCGATAATTACAACGGTTACAATTTAGACAAAATTTACATTGTCAGTAAATTC

TACGAGTCCGTATCTCAAAAGACGTATCGTGATTGGGAGACTATCAATACGGCCCTGGAG

ATCCACTACAACAATATCTTGCCCGGTAATGGTAAGTCGAAGGCCGATAAAGTTAAGAAA

-continued

GCGGTGAAAAATGACTTACAGAAGTCAATCACCGAAATTAACGAATTGGTGTCCAATTAT
AAATTGTGTTCAGATGATAATATCAAAGCCGAGACCTACATTCATGAGATTTCCCATATC
TTAAATAATTTCGAGGCGCAAGAGCTTAAGTATAACCCAGAAATCCACCTGGTAGAATCT
GAGTTGAAGGCGTCAGAGTTAAAAAATGTTTTAGATGTCATTATGAACGCGTTTCACTGG
TGCTCCGTATTTATGACGGAGGAATTAGTAGATAAAGACAACAATTTCTATGCCGAACTT
GAGGAAATCTATGATGAGATCTATCCCGTCATTAGCCTGTATAACTTGGTCCGCAACTAT
GTTACCCAAAAACCGTACAGTACCAAGAAGATTAAGCTGAATTTCGGCATTCCTACACTG
GCTGATGGTTGGAGTAAATCGAAGGAATATTCGAATAACGCGATTATCTTGATGCGCGAC
AACTTATACTATTTGGGGATCTTTAACGCCAAAAACAAACCGGATAAGAAGATTATTGAG
GGAAACACATCAGAGAACAAAGGCGACTACAAAAAAATGATTTACAACTTGTTACCGGGG
CCTAACAAAATGATCCCGAAGGTGTTCTTATCCAGTAAAACAGGCGTTGAGACCTACAAA
CCTTCCGCATACATCCTGGAAGGGTATAAGCAGAACAAGCACATTAAGTCCAGCAAGGAT
TTCGATATTACCTTCTGTCATGATTTAATTGACTATTTCAAGAACTGTATTGCAATCCAC
CCCGAGTGGAAGAACTTCGGATTCGACTTCTCAGATACGAGCACATATGAGGACATCTCG
GGGTTCTATCGTGAAGTAGAACTGCAGGGATATAAAATTGATTGGACATATATTTCCGAA
AAAGACATCGACCTTTTACAAGAGAAGGGTCAACTTTACTTGTTCCAAATTTACAATAAA
GACTTCTCAAAAAAAAGCACGGGTAACGATAATTTACACACTATGTATTTAAAGAACCTT
TTCTCGGAAGAGAATTTAAAGGATATCGTATTGAAGTTGAATGGAGAAGCGGAGATCTTC
TTCCGTAAGTCCAGTATTAAAAACCCTATTATTCACAAGAAGGGATCGATTTTAGTTAAC
CGCACATACGAGGCCGAAGAGAAGGACCAATTTGGGAACATTCAAATTGTCCGCAAAAAC
ATCCCTGAGAACATTTATCAAGAGCTTTATAAGTACTTTAACGATAAGTCCGATAAGGAA
TTGTCAGATGAGGCGGCAAAGTTGAAGAATGTCGTGGGGCATCATGAAGCTGCCACCAAC
ATTGTGAAGGACTACCGCTACACTTACGACAAATACTTCCTGCACATGCCCATTACGATC
AATTTTAAGGCCAATAAGACAGGCTTTATTAACGACCGTATTCTTCAATATATCGCTAAG
GAGAAGGACCTTCATGTGATTGGGATCGACCGCGGAGAACGTAATTTAATTTATGTGTCC
GTCATCGATACGTGTGGAAATATCGTGGAACAGAAATCATTCAATATCGTGAATGGCTAT
GATTACCAGATCAAATTAAAACAGCAGGAGGGCGCTCGCCAAATTGCGCGTAAGGAATGG
AAAGAGATCGGAAAAATCAAAGAAATCAAAGAAGGATATTTGTCATTGGTGATCCATGAG
ATTTCAAAAATGGTAATTAAATATAATGCAATTATCGCAATGGAAGACCTGTCCTATGGT
TTTAAGAAGGGTCGTTTCAAGGTAGAACGCCAAGTGTATCAAAAGTTCGAGACGATGCTG
ATCAATAAGCTGAATTATCTTGTGTTTAAGGACATTAGCATCACGGAAAATGGAGGGCTG
TTGAAAGGCTATCAACTGACGTATATCCCTGACAAGCTGAAAAATGTTGGCCATCAGTGC
GGGTGCATTTTCTACGTCCCCGCGGCGTATACAAGCAAGATCGATCCTACTACGGGATTC
GTAAATATTTTTAAATTCAAAGACTTAACCGTGGACGCCAAGCGCGAATTCATTAAGAAG
TTTGATAGCATTCGCTACGATTCAGAAAAAAATCTTTTCTGTTTTACGTTCGATTACAAC
AATTTTATCACCCAGAACACAGTGATGAGCAAGTCATCCTGGTCTGTCTATACCTACGGT
GTCCGTATCAAACGCCGCTTCGTCAACGGACGCTTCTCTAATGAATCTGATACCATTGAC
ATCACCAAGGACATGGAAAAGACACTTGAGATGACAGATATTAACTGGCGTGACGGACAT
GACCTGCGTCAGGACATCATCGATTATGAGATTGTTCAGCATATCTTCGAGATCTTCCGC
CTGACAGTACAAATGCGCAATTCACTGTCAGAACTTGAAGACCGCGACTATGACCGCCTG
ATCTCTCCAGTATTAAATGAGAACAATATCTTTTATGACAGTGCTAAGGCCGGCGATGCC

-continued

CTTCCGAAAGATGCTGATGCTAACGGAGCTTATTGTATTGCATTAAAGGGTCTTTATGAG

ATCAAGCAAATTACCGAGAATTGGAAGGAGGATGGCAAATTCTCGCGCGACAAACTGAAA

ATCAGTAACAAGGACTGGTTCGATTTTATTCAGAATAAACGTTACCTGAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 95
CCAGCGGCTAAAAAAAAGAAACTGGATGGCAGCGTGGATATGAATAACGGAACGAACAAC

TTCCAGAACTTCATCGGCATCAGTTCTTTACAAAAAACCCTGCGTAACGCCCTTATTCCG

ACTGAGACAACACAACAGTTCATCGTTAAAAACGGAATTATCAAAGAGGACGAGTTGCGC

GGCGAGAATCGCCAAATTTTGAAAGATATTATGGACGACTATTATCGTGGTTTTATTTCA

GAAACACTGAGTTCGATTGACGATATCGATTGGACGAGCCTGTTTGAGAAAATGGAAATC

CAGTTGAAAAATGGCGATAATAAAGACACTTTAATCAAAGAACAAACCGAGTATCGTAAA

GCGATCCATAAAAAGTTCGCTAATGACGATCGTTTTAAGAATATGTTCAGTGCGAAACTG

ATTTCAGACATTTTGCCCGAGTTCGTGATCCATAATAACAACTATTCCGCCTCGGAAAAG

GAAGAAAAAACCCAGGTGATTAAGCTGTTCAGTCGCTTCGCAACATCTTTCAAGGATTAT

TTCAAGAATCGCGCGAATTGCTTCAGTGCGGACGATATTTCTAGTTCAAGCTGCCATCGT

ATCGTTAATGATAACGCGGAGATTTTTTTTAGCAATGCTCTGGTGTACCGCCGCATTGTT

AAGTCACTGTCCAACGATGATATTAACAAGATCTCAGGAGACATGAAAGACTCGCTTAAA

GAGATGAGTCTGGAAGAGATCTATTCTTATGAGAAGTATGGCGAGTTTATTACCCAAGAA

GGAATCTCATTCTACAATGATATTTGTGGAAAGGTGAACAGCTTTATGAATCTTTACTGC

CAAAAAAACAAGGAGAATAAGAATCTTTACAAACTTCAGAAGTTACATAAACAGATTTTG

TGTATTGCGGATACGTCTTATGAAGTCCCCTACAAATTTGAATCGGATGAAGAGGTATAC

CAAAGTGTGAACGGATTCTTGGACAATATTTCTTCTAAACATATTGTTGAACGCTTACGT

AAGATCGGGGATAACTACAATGGCTACAATCTTGACAAAATCTACATTGTTAGCAAATTC

TACGAGAGTGTCAGCCAAAAGACGTACCGCGATTGGGAAACAATTAATACTGCGCTTGAG

ATTCACTATAATAACATTTTACCAGGCAACGGCAAGTCCAAGGCGGATAAAGTTAAAAAA

GCTGTTAAAAACGATTTGCAAAAATCTATCACAGAAATTAACGAGTTAGTTAGTAACTAC

AAACTGTGCTCCGATGACAACATTAAGGCTGAGACGTATATCCATGAGATCTCTCACATC

TTAAACAATTTTGAAGCTCAAGAACTTAAGTACAATCCGGAAATCCACCTGGTGGAATCC

GAGCTGAAGGCTAGCGAACTGAAGAACGTATTGGACGTGATCATGAACGCGTTCCACTGG

TGTTCTGTCTTTATGACGGAAGAGCTTGTCGACAAAGATAATAACTTTTACGCGGAACTT

GAGGAAATTTACGATGAGATTTACCCAGTTATTTCATTGTATAACCTTGTCCGTAATTAC

GTGACCCAAAAGCCTTATAGTACGAAAAAAATCAAATTAAATTTTGGAATCCCAACACTG

GCTGACGGTTGGAGCAAATCTAAGGAGTATTCTAATAACGCAATCATCTTAATGCGTGAC

AACCTGTATTATTTGGGTATCTTCAATGCCAAAAATAAGCCTGACAAAAAGATTATCGAA

GGAAATACTTCGGAGAATAAGGGGGATTACAAAAAAATGATTTACAATTTGCTGCCCGGG

CCGAACAAGATGATCCCCAAAGTGTTCTTATCCTCGAAGACTGGTGTAGAAACATACAAG

CCAAGCGCATACATTCTGGAGGGTTACAAGCAAAACAAACACATCAAATCTTCAAAAGAC

TTTGACATTACATTTTGCCATGATCTTATTGACTACTTCAAAAACTGCATTGCTATTCAC

CCCGAGTGGAAGAACTTTGGGTTTGACTTCAGCGACACGTCTACGTATGAGGACATCTCC

-continued

GGGTTCTACCGTGAAGTTGAGTTACAAGGGTATAAGATTGACTGGACGTATATTTCAGAG

AAAGATATCGATCTTTTGCAGGAAAAGGGCCAGTTATATTTATTCCAGATTTACAACAAG

GACTTTAGTAAGAAGTCAACAGGAAATGACAACTTGCATACGATGTATTTGAAAAATCTT

TTTTCTGAGGAAAATCTTAAGGACATCGTACTGAAATTGAATGGCGAGGCTGAAATCTTC

TTCCGTAAATCCTCCATTAAGAATCCCATTATCCACAAAAAGGGGTCTATCCTGGTGAAT

CGTACCTACGAGGCAGAGGAGAAGGATCAATTCGGAAATATTCAGATTGTTCGTAAGAAC

ATCCCCGAGAACATTTATCAAGAATTGTATAAGTACTTTAATGACAAATCTGACAAAGAG

TTATCCGACGAAGCTGCGAAACTGAAAAACGTTGTTGGTCACCACGAGGCCGCCACTAAT

ATCGTAAAAGACTACCGTTATACCTATGACAAGTACTTTTTGCACATGCCGATCACTATC

AACTTCAAGGCGAATAAGACGGGCTTCATTAACGATCGTATCCTGCAATACATCGCCAAG

GAGAAGGACCTTCACGTCATTGGGATTGACCGTGGTGAGCGTAACCTGATTTATGTAAGC

GTCATTGATACCTGCGGTAATATCGTCGAACAGAAAAGTTTCAACATTGTAAATGGATAT

GACTATCAGATCAAACTTAAGCAGCAGGAGGGTGCACGCCAGATTGCCCGCAAGGAATGG

AAGGAGATTGGGAAGATTAAGGAAATTAAAGAAGGTTACTTATCACTGGTTATTCACGAG

ATCAGTAAAATGGTAATCAAATATAACGCGATCATTGCCATGGAGGATCTGAGCTATGGC

TTTAAAAAGGGCCGTTTCAAAGTCGAGCGCCAGGTATATCAAAAGTTTGAAACAATGCTG

ATTAACAAATTAAACTATCTGGTTTTCAAAGATATTTCGATCACTGAAAATGGCGGGCTG

TTGAAGGGATACCAACTTACATACATCCCTGACAAACTGAAAAATGTCGGTCACCAATGT

GGATGTATCTTTTATGTACCAGCAGCGTATACGAGCAAAATCGATCCAACTACGGGTTTT

GTGAACATCTTTAAGTTCAAGGATTTGACAGTAGATGCCAAACGCGAGTTCATTAAAAAA

TTTGATTCAATTCGCTACGATTCAGAGAAAAATCTTTTTTGTTTCACGTTCGATTACAAT

AATTTCATTACGCAGAACACAGTAATGTCAAAGTCAAGCTGGTCGGTCTACACGTATGGA

GTCCGTATTAAACGTCGTTTTGTAAACGGCCGTTTCTCAAATGAATCAGATACAATTGAT

ATTACGAAGGATATGGAGAAGACATTAGAGATGACTGACATTAACTGGCGCGACGGACAT

GATCTTCGTCAGGACATTATTGATTATGAGATTGTACAGCATATCTTTGAGATCTTCCGC

CTGACCGTTCAGATGCGCAATTCGTTGTCCGAGTTAGAAGACCGCGATTACGACCGTTTA

ATCAGTCCCGTCTTAAACGAAAATAACATCTTCTACGATTCAGCCAAGGCAGGCGATGCC

TTGCCAAAGGATGCTGACGCAAATGGCGCATACTGTATTGCGTTGAAAGGCCTTTATGAA

ATCAAGCAAATTACCGAAAACTGGAAAGAAGACGGAAAATTCTCCCGTGATAAGTTGAAA

ATCTCTAATAAGGATTGGTTCGATTTCATCCAAAATAAACGCTATTTGAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 96

CCAGCGGCTAAAAAAAAGAAACTGGATGGCAGCGTGGATATGAACAACGGAACTAATAAT

TTCCAAAATTTTATAGGCATCTCTTCTTTACAGAAGACTCTTCGTAACGCCCTAATCCCG

ACTGAGACCACACAACAATTCATAGTGAAAAATGGGATCATTAAAGAAGACGAGCTGCGT

GGGGAGAACAGGCAGATCCTAAAAGACATAATGGACGATTATTATAGAGGGTTCATCTCA

GAGACATTATCTAGCATCGACGACATTGACTGGACCTCCCTGTTTGAAAAAATGGAAATC

CAGCTGAAGAATGGTGACAATAAAGACACATTAATAAAAGAACAAACAGAGTACAGGAAA

GCCATCCACAAGAAGTTCGCAAACGATGACAGATTCAAAAATATGTTCAGTGCGAAGCTA

ATATCCGACATCTTACCAGAGTTTGTAATACACAATAACAATTACAGCGCGAGCGAAAAG

GAAGAGAAAACGCAAGTAATTAAGCTTTTTAGTAGGTTCGCTACCTCTTTCAAAGATTAC

TTCAAAAATCGTGCTAACTGCTTCTCAGCCGACGACATATCTTCAAGTTCCTGTCACCGT

ATCGTGAATGATAACGCTGAGATATTCTTCTCAAACGCCCTTGTATACCGTAGGATCGTA

AAGTCCTTATCTAACGATGATATAAACAAGATCAGTGGAGACATGAAAGACAGCCTTAAA

GAGATGTCTCTAGAAGAAATTTACTCCTATGAAAAGTATGGGGAGTTTATAACACAGGAG

GGGATCAGCTTCTACAACGACATCTGCGGAAAGGTGAACAGTTTCATGAATCTTTACTGC

CAGAAGAATAAAGAGAACAAAAATCTTTATAAGCTTCAAAAGTTGCACAAACAAATACTG

TGCATTGCCGATACATCATATGAGGTCCCCTATAAGTTCGAATCTGATGAGGAAGTTTAT

CAATCTGTTAACGGCTTTCTAGACAATATCAGCTCAAAACACATCGTAGAAAGACTGAGG

AAAATAGGTGATAATTATAATGGATACAACTTGGATAAAATATATATAGTCTCTAAATTT

TACGAGTCAGTATCCCAGAAAACGTATAGGGATTGGGAGACCATCAACACGGCGTTAGAG

ATTCATTACAATAACATCTTACCGGGAAACGGAAAAAGTAAGGCGGACAAAGTAAAGAAA

GCCGTTAAAAATGACTTACAAAAGAGTATAACAGAAATAAACGAACTAGTAAGCAACTAC

AAGCTTTGTTCCGATGATAATATCAAGGCCGAGACATATATCCATGAGATCTCCCACATT

CTAAACAATTTCGAAGCGCAAGAACTTAAATATAATCCCGAAATCCACCTGGTGGAAAGT

GAACTAAAGGCTAGTGAGTTAAAGAACGTTCTTGATGTTATCATGAACGCCTTCCATTGG

TGCTCTGTTTTTATGACCGAGGAGTTGGTTGATAAAGATAATAATTTCTACGCTGAATTA

GAGGAGATATACGACGAAATCTACCCAGTGATTTCACTATACAACTTGGTCAGGAACTAT

GTTACACAAAAGCCGTACAGCACTAAGAAAATTAAGCTAAATTTCGGTATCCCCACGTTA

GCCGACGGGTGGAGCAAGTCCAAAGAATATTCCAACAATGCGATTATTTTAATGCGTGAC

AATCTTTATTACCTTGGCATCTTCAATGCCAAAAACAAACCTGACAAAAAGATTATAGAA

GGTAATACGTCCGAGAACAAAGGCGATTACAAGAAGATGATTTATAACCTACTGCCCGGA

CCAAACAAAATGATCCCCAAAGTTTTTCTTAGTTCTAAAACCGGCGTAGAGACGTATAAA

CCTTCTGCCTATATCTTAGAGGGATATAAGCAGAACAAACATATCAAATCTTCCAAGGAC

TTTGATATTACATTCTGCCACGATTTAATTGACTACTTCAAAAATTGCATAGCGATACAT

CCGGAGTGGAAGAACTTTGGCTTCGACTTCAGTGATACATCCACCTATGAGGATATATCA

GGCTTCTATCGTGAGGTCGAATTGCAAGGGTACAAAATCGATTGGACGTATATATCCGAG

AAAGACATAGACCTTCTTCAAGAAAAGGGGCAGTTATATTTATTCCAAATATACAACAAG

GACTTCAGTAAGAAGTCAACAGGTAATGACAACTTACACACCATGTACTTGAAAAATTTA

TTTTCTGAAGAAAACCTAAAGGACATTGTACTAAAACTGAACGGGGAGGCAGAAATTTTT

TTTAGAAAGAGCAGCATAAAAAACCCAATAATTCATAAGAAAGGAAGCATTTTAGTTAAT

AGGACGTACGAGGCAGAGGAAAAGGACCAGTTTGGCAATATCCAGATCGTAAGGAAAAAT

ATTCCTGAAAACATATATCAGGAACTATATAAATACTTTAACGACAAATCCGACAAAGAA

TTATCCGACGAGGCTGCAAAGCTGAAGAACGTCGTAGGGCACCATGAGGCAGCGACTAAT

ATTGTGAAAGACTATAGGTATACATACGACAAATACTTTCTGCACATGCCCATCACGATT

AACTTCAAGGCGAACAAGACGGGATTCATTAACGACCGTATATTACAATATATTGCTAAG

GAGAAAGATCTGCATGTAATAGGTATCGACAGAGGCGAACGTAATTTAATCTACGTGTCC

GTCATCGACACGTGCGGGAACATCGTAGAGCAAAAGAGTTTTAATATAGTAAATGGCTAT

GATTACCAAATTAAGCTAAAGCAGCAAGAAGGAGCAAGACAGATAGCTAGGAAAGAATGG

AAGGAGATAGGAAAAATAAAGGAGATCAAGGAGGGGTATCTTAGCCTAGTAATTCATGAA

-continued

ATATCTAAGATGGTTATCAAATACAACGCTATCATAGCGATGGAAGACTTATCTTATGGT

TTCAAGAAAGGAAGGTTCAAAGTAGAGCGTCAAGTTTATCAAAAGTTCGAAACGATGTTG

ATTAATAAACTAAACTATTTGGTATTTAAAGATATATCTATCACCGAGAATGGTGGTCTA

CTAAAGGGTTACCAGCTTACATACATACCGGACAAACTTAAAAACGTCGGACATCAGTGT

GGATGCATTTTCTACGTTCCAGCTGCATATACCAGCAAGATCGACCCAACGACTGGGTTC

GTAAATATTTTTAAATTCAAGGATTTGACTGTCGACGCCAAAAGAGAGTTCATAAAAAAG

TTCGATTCAATTAGGTACGACAGCGAAAAGAATTTGTTCTGCTTTACTTTTGACTATAAC

AATTTCATTACTCAGAACACTGTAATGTCTAAGTCCTCTTGGTCAGTCTATACTTATGGC

GTTCGTATCAAACGTAGATTTGTTAACGGTAGATTCTCAAATGAAAGTGATACAATAGAT

ATCACGAAAGATATGGAGAAAACATTAGAAATGACAGACATAAACTGGAGAGACGGACAT

GACTTGAGACAGGACATTATTGACTACGAGATCGTGCAGCACATCTTTGAGATCTTTCGT

TTGACCGTACAAATGCGTAACAGTTTATCTGAGCTTGAGGACAGGGACTACGATAGATTG

ATATCACCTGTATTAAATGAGAATAACATCTTCTATGATTCCGCAAAAGCAGGCGACGCT

CTACCCAAAGACGCTGATGCGAACGGTGCTTATTGCATAGCTTTAAAGGGTTTGTATGAG

ATCAAACAGATAACAGAAAATTGGAAGGAAGATGGTAAGTTCTCCCGTGACAAGCTTAAA

ATATCAAATAAGGACTGGTTCGATTTTATACAGAATAAGCGTTATTAAAACGTCCGGCAG

CGACCAAAAAAGCCGGCCAGGCGAAGAAAAAAAAAGCGTCAGGTAGCGGCGCAGGCAGCC

CGAAAAAGAAACGTAAAGTCGAGGATCCGAAAAAGAAACGTAAGGTTATTCCGGGCTAA

SEQ ID NO: 97

CCAGCGGCTAAAAAAAAGAAACTGGATGGCAGCGTGGATATGAACAATGGAACTAATAAC

TTCCAGAATTTCATTGGTATCTCCTCTTTACAAAAAACTCTAAGAAACGCCCTAATTCCG

ACTGAAACTACACAGCAATTCATCGTCAAAAACGGGATCATTAAGGAGGATGAGTTGAGG

GGTGAAAATCGTCAAATTCTTAAAGACATCATGGACGACTACTACAGGGGGTTCATCAGC

GAGACGTTATCTAGTATAGACGATATAGACTGGACTTCACTGTTCGAGAAGATGGAAATC

CAATTAAAAAATGGGGACAATAAAGATACACTTATAAAGGAACAGACAGAGTATAGAAAG

GCAATACACAAAAAGTTTGCCAACGACGATCGTTTCAAGAACATGTTTAGTGCTAAATTG

ATTTCAGATATTCTGCCGGAATTTGTTATTCACAACAATAATTATAGCGCCAGTGAGAAA

GAAGAAAAAACGCAGGTTATCAAACTGTTCAGTCGTTTCGCTACATCTTTTAAGGATTAC

TTTAAAAACCGTGCAAATTGTTTTTCAGCCGACGATATTAGTAGCAGCTCTTGTCACCGT

ATTGTTAATGATAATGCGGAGATTTTCTTTTCAAACGCATTGGTCTACAGGAGGATAGTC

AAGTCCCTTTCAAATGACGACATTAATAAGATCTCAGGTGACATGAAAGATTCCTTAAAG

GAAATGTCCCTGGAAGAGATCTATTCCTATGAAAAGTACGGTGAGTTCATTACTCAAGAG

GGTATAAGCTTTTACAATGACATATGTGGTAAGGTTAATAGCTTTATGAACCTGTATTGC

CAGAAGAACAAAGAAAATAAGAATCTGTATAAGTTGCAAAAGCTACACAAACAAATTTTG

TGCATTGCCGATACATCATACGAGGTGCCATACAAATTCGAGAGCGATGAGGAGGTTTAT

CAGAGCGTGAATGGATTCCTGGACAATATTAGTAGTAAGCATATCGTGGAAAGGCTTAGA

AAGATAGGTGACAATTACAATGGCTACAATCTGGATAAAATCTACATCGTCTCAAAATTC

TATGAAAGTGTATCCCAGAAGACGTACCGTGATTGGGAAACTATCAACACCGCTCTGGAG

ATACATTACAACAATATACTTCCCGGAAACGGCAAGTCAAAAGCCGACAAAGTCAAAAAA

GCGGTCAAGAACGATTTACAAAAGTCTATCACTGAAATTAATGAATTAGTTAGTAATTAC

AAACTGTGTAGTGATGATAATATTAAGGCAGAGACTTACATACACGAAATTTCACACATT

-continued

TTAAACAACTTCGAGGCACAGGAACTTAAATATAATCCTGAAATTCACCTGGTTGAAAGT

GAATTGAAAGCCAGCGAGCTAAAGAACGTTTTGGACGTAATCATGAACGCATTCCACTGG

TGCTCTGTCTTTATGACAGAGGAACTAGTGGATAAGGACAATAATTTTTATGCGGAGCTG

GAGGAAATATACGATGAGATATATCCCGTAATATCATTATATAATCTGGTAAGAAACTAT

GTGACTCAAAAGCCGTATAGCACCAAGAAAATTAAACTTAATTTCGGCATACCCACTTTA

GCGGACGGCTGGTCAAAATCCAAAGAGTATAGTAATAATGCCATCATCCTGATGCGTGAC

AACCTGTACTATTTAGGTATATTTAACGCCAAAAATAAACCCGACAAAAAGATTATAGAG

GGCAACACCTCAGAGAACAAAGGTGATTATAAGAAGATGATTTACAACCTTTTACCCGGT

CCTAATAAGATGATTCCCAAAGTCTTTCTATCTAGCAAAACTGGTGTTGAAACATACAAA

CCCTCAGCTTATATTTTAGAAGGGTATAAGCAGAATAAGCATATTAAAAGCTCCAAAGAT

TTCGATATTACCTTTTGCCATGACTTGATAGACTATTTCAAAAATTGTATTGCCATTCAC

CCTGAATGGAAAAACTTCGGATTTGACTTCTCTGACACATCCACCTACGAAGACATTTCA

GGTTTTTACAGGGAAGTCGAGCTACAGGGTTATAAAATTGATTGGACATACATCAGCGAG

AAAGATATTGACCTACTTCAAGAAAAAGGGCAGCTATACCTGTTCCAGATATACAATAAA

GACTTCAGTAAAAAAAGCACCGGGAACGATAATCTTCACACAATGTACTTAAAAAATTTA

TTTAGTGAAGAGAATCTGAAGGATATAGTGCTGAAGTTAAACGGGGAGGCAGAGATATTT

TTTAGAAAATCTAGTATTAAGAATCCGATCATCCACAAGAAGGGTTCTATCCTTGTTAAT

AGGACTTATGAGGCAGAAGAAAAAGACCAATTCGGCAACATACAAATTGTCCGTAAAAAT

ATCCCTGAGAACATTTATCAGGAACTATACAAGTACTTCAATGATAAAAGCGACAAGGAG

CTGAGCGACGAGGCTGCTAAGTTAAAGAATGTGGTGGGCCACCATGAGGCAGCAACGAAT

ATTGTGAAGGACTATCGTTATACCTACGATAAATACTTTCTTCATATGCCGATCACCATT

AATTTCAAGGCAAACAAAACTGGCTTCATTAACGATCGTATCTTACAATATATCGCAAAA

GAGAAAGACCTTCACGTTATCGGGATCGATAGAGGCGAGCGTAACCTAATTTATGTTTCT

GTGATAGACACCTGTGGGAACATAGTCGAACAGAAATCATTTAATATTGTTAACGGCTAC

GATTATCAGATAAAGTTGAAGCAACAAGAGGGTGCACGTCAAATAGCAAGGAAAGAATGG

AAAGAAATAGGCAAGATTAAAGAAATAAAAGAAGGTTATTTATCCCTTGTAATACACGAA

ATTAGCAAAATGGTGATTAAATATAATGCGATCATTGCCATGGAGGATCTTTCTTACGGC

TTCAAAAAGGGGAGATTCAAAGTCGAGAGGCAGGTGTATCAGAAGTTTGAGACCATGCTA

ATCAATAAACTAAATTATCTAGTATTCAAAGACATAAGCATCACCGAAAATGGCGGCTTG

TTGAAGGGTTATCAATTGACCTACATCCCAGATAAACTAAAAAACGTAGGGCATCAATGC

GGATGTATATTTTACGTTCCAGCCGCATACACTTCCAAAATCGATCCAACTACGGGTTTT

GTGAACATCTTCAAATTCAAAGACTTGACTGTCGATGCTAAGAGGGAGTTTATCAAGAAA

TTTGACTCCATTAGATACGACAGTGAGAAGAATCTGTTCTGTTTTACCTTTGATTATAAC

AACTTTATAACTCAAAACACAGTCATGAGTAAGTCATCTTGGTCAGTGTATACGTATGGT

GTGAGGATTAAAAGGAGGTTTGTTAACGGGAGATTTTCCAATGAAAGTGATACAATAGAT

ATAACCAAGGACATGGAAAAGACTCTTGAAATGACCGACATTAACTGGAGAGATGGCCAC

GACTTACGTCAAGATATAATCGATTACGAGATAGTGCAACATATCTTTGAGATATTTAGG

CTTACTGTCCAAATGCGTAACTCATTAAGTGAGTTGGAGGACAGGGATTACGATAGGCTA

ATAAGTCCTGTTCTTAACGAAAACAATATATTCTACGATTCAGCAAAGGCGGGAGACGCC

CTGCCCAAGGACGCGGATGCTAACGGCGCATACTGTATTGCCCTGAAAGGCTTGTACGAG

ATAAAACAGATCACGGAGAACTGGAAAGAAGATGGAAAATTCAGTCGTGACAAGTTAAAA

-continued

ATTAGTAACAAAGACTGGTTCGACTTTATTCAGAACAAGAGATATCTGAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 98
CCAGCGGCTAAAAAAAAGAAACTGGATGGCAGCGTGGATATGAACAACGGAACCAATAAC

TTTCAAAACTTTATAGGCATCTCCAGTCTACAGAAGACACTACGTAACGCTTTGATACCA

ACTGAGACCACGCAGCAGTTTATCGTCAAGAACGGTATTATAAAGGAAGACGAGCTAAGG

GGGGAAAACCGTCAGATCTTAAAGGACATCATGGATGACTACTACAGAGGCTTCATAAGT

GAGACTTTGTCTAGTATAGACGACATCGACTGGACCAGTTTATTTGAGAAGATGGAAATT

CAGTTAAAGAACGGGGACAATAAAGACACACTAATTAAAGAGCAGACCGAATACAGAAAA

GCTATACACAAAAAGTTTGCCAACGATGATAGATTCAAAAATATGTTTTCAGCAAAATTG

ATTTCCGACATATTGCCAGAATTCGTAATCCATAATAACAATTATTCTGCAAGTGAGAAG

GAAGAGAAGACCCAAGTAATCAAGCTGTTTTCCCGTTTTGCTACGAGTTTCAAAGATTAT

TTCAAGAATAGGGCTAATTGTTTCTCCGCGGACGACATAAGTAGCAGTTCCTGTCACAGG

ATTGTGAACGATAATGCTGAGATATTTTTTTCCAATGCCCTAGTGTATAGGAGAATAGTT

AAAAGCTTAAGCAACGACGATATCAATAAAATTTCAGGGGACATGAAGGACAGCTTAAAG

GAAATGAGTTTGGAGGAGATTTACAGTTATGAAAAATACGGAGAGTTTATAACTCAGGAA

GGCATCTCTTTCTATAATGATATCTGTGGGAAGGTAAACTCCTTCATGAATTTATATTGC

CAGAAGAATAAGGAAAACAAAAATCTTTACAAGCTTCAAAAGTTACATAAGCAGATCTTA

TGTATTGCCGACACGAGTTATGAAGTGCCTTATAAATTCGAGAGTGATGAGGAAGTGTAT

CAGTCTGTTAACGGATTCCTAGATAATATAAGTTCCAAACATATAGTCGAGAGGCTGAGG

AAGATTGGCGATAACTATAATGGATATAATCTTGACAAAATCTATATAGTCTCTAAATTT

TATGAAAGCGTCAGCCAGAAGACATATAGAGATTGGGAAACTATAAACACAGCCCTTGAA

ATACATTACAATAACATCCTACCCGGCAATGGTAAGTCTAAGGCAGACAAAGTTAAAAAA

GCAGTAAAGAATGACTTACAGAAGTCAATCACGGAGATAAATGAGTTGGTCAGTAACTAC

AAATTATGCTCCGACGATAATATTAAGGCCGAAACATATATACACGAGATAAGTCATATA

TTAAACAATTTCGAAGCCCAGGAGTTAAAATATAACCCTGAAATTCATCTGGTCGAAAGT

GAGTTAAAGGCCAGTGAGTTAAAGAATGTACTTGACGTAATTATGAATGCTTTTCATTGG

TGCTCCGTGTTCATGACCGAGGAGTTAGTAGATAAAGACAATAACTTTTACGCCGAACTT

GAAGAGATATACGACGAGATTTATCCGGTAATCAGCTTGTACAACTTAGTTAGAAATTAT

GTAACACAGAAGCCTTACTCTACTAAAAAAATAAAACTGAACTTTGGTATCCCAACTCTT

GCAGATGGTTGGAGTAAAAGCAAGGAATATAGCAACAATGCGATCATCTTGATGAGAGAC

AACTTGTACTATTTGGGAATCTTCAACGCGAAAAATAAACCCGACAAAAAAATCATCGAA

GGGAATACCTCTGAGAATAAAGGTGACTATAAGAAAATGATTTACAATCTACTTCCTGGT

CCTAATAAAATGATCCCGAAAGTGTTTCTTAGTTCTAAGACTGGTGTCGAGACGTACAAA

CCTAGCGCGTACATCTTAGAAGGGTACAAGCAGAATAAACACATCAAATCAAGCAAAGAC

TTCGATATTACTTTTTGCCATGACTTGATAGACTACTTTAAAAACTGCATAGCAATCCAC

CCGGAGTGGAAAAACTTTGGCTTTGATTTCTCTGACACCTCTACATATGAGGACATATCT

GGTTTTTACCGTGAGGTTGAATTGCAGGGATACAAAATTGACTGGACTTACATATCTGAA

AAAGATATCGATCTATTGCAGGAGAAAGGCCAGCTTTACCTTTTCCAGATCTATAATAAG

-continued

GACTTCTCTAAGAAGTCTACAGGGAATGATAATTTGCACACTATGTACTTAAAAAATCTG

TTTTCCGAGGAAAACTTGAAAGACATTGTTTTAAAGTTGAACGGAGAAGCTGAAATATTT

TTCAGAAAGAGCTCCATAAAAAACCCGATCATTCATAAGAAGGGATCTATCCTGGTTAAC

AGAACGTACGAAGCGGAAGAAAAAGACCAATTCGGAAACATTCAAATTGTTAGAAAGAAT

ATCCCTGAGAACATCTACCAGGAGTTATATAAGTATTTTAATGATAAGTCAGATAAGGAA

CTATCTGACGAAGCGGCGAAGCTTAAAAATGTTGTAGGACACCATGAGGCTGCTACAAAT

ATAGTCAAGGACTACCGTTATACCTACGATAAGTACTTTCTACACATGCCCATTACCATC

AATTTTAAAGCTAATAAAACGGGTTTTATCAACGATCGTATCCTACAATATATTGCGAAA

GAGAAGGATTTGCATGTCATTGGCATTGATAGAGGTGAGAGGAACCTAATATACGTATCC

GTGATTGATACGTGCGGGAACATAGTTGAACAGAAATCATTTAATATAGTTAATGGGTAC

GACTATCAGATTAAGCTAAAGCAACAAGAAGGCGCCAGGCAAATTGCCCGTAAAGAATGG

AAAGAGATCGGGAAGATCAAGGAAATAAAAGAAGGATACCTTTCCCTGGTCATCCATGAA

ATTAGCAAAATGGTGATTAAGTACAATGCCATAATCGCGATGGAGGACTTAAGCTACGGG

TTCAAAAAGGGGAGGTTTAAGGTGGAGAGGCAAGTGTACCAGAAATTTGAGACCATGCTA

ATCAACAAACTGAACTACCTAGTTTTTAAGGACATTTCAATTACAGAGAATGGAGGACTT

TTAAAGGGTTACCAACTAACGTATATACCAGATAAGTTGAAAAATGTCGGTCACCAGTGT

GGCTGCATCTTTTACGTTCCCGCCGCTTATACATCTAAAATTGATCCAACCACAGGCTTT

GTAAATATCTTTAAATTCAAAGATTTAACTGTGGATGCAAAAAGAGAGTTTATCAAGAAA

TTCGATAGCATTCGTTATGATAGCGAGAAGAACCTGTTCTGCTTTACTTTCGACTATAAC

AACTTTATAACTCAAAACACCGTGATGTCAAAAAGCTCATGGTCAGTCTACACCTATGGT

GTAAGGATTAAAAGGCGTTTCGTGAATGGGAGATTCTCCAATGAAAGTGACACGATCGAC

ATAACAAAGGACATGGAGAAGACACTAGAGATGACTGATATTAATTGGAGAGACGGACAC

GATCTGCGTCAAGATATAATTGATTATGAGATAGTACAGCACATATTTGAGATCTTCCGT

TTGACTGTCCAAATGCGTAATTCCCTTTCTGAGCTGGAAGATAGGGACTATGATAGATTA

ATATCCCCTGTACTAAATGAGAACAACATTTTCTATGATAGTGCAAAAGCCGGGGATGCA

TTGCCGAAAGACGCTGACGCTAATGGGGCGTACTGTATAGCTTTAAAGGGGCTTTACGAA

ATAAAGCAGATAACCGAAAACTGGAAGGAAGATGGCAAATTCTCAAGGGACAAACTTAAG

ATCTCTAACAAGGATTGGTTCGATTTTATACAAAACAAACGTTATTTGAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 99

CCAGCGGCTAAAAAAAAGAAACTGGATGGCAGCGTGGATATGAATAATGGTACAAACAAC

TTTCAGAATTTCATTGGGATCTCTAGCTTACAGAAGACCCTGAGGAATGCGTTGATTCCA

ACTGAAACAACCCAGCAATTCATCGTGAAAAATGGGATAATCAAAGAGGATGAGTTAAGG

GGTGAAAACCGTCAAATATTGAAGGATATTATGGACGACTACTACCGTGGATTCATCTCA

GAGACGTTGAGCAGCATTGACGACATAGACTGGACTAGCCTTTTCGAGAAGATGGAAATT

CAGTTAAAGAACGGAGATAACAAAGATACACTAATCAAGGAACAGACAGAATACAGAAAA

GCAATTCATAAGAAATTCGCTAATGACGATCGTTTTAAAAACATGTTCTCTGCAAAATTA

ATTAGCGACATTCTGCCGGAATTCGTTATACATAATAATAACTACAGTGCTTCTGAAAAG

GAAGAGAAAACTCAGGTAATAAAACTGTTCTCTCGTTTTGCCACATCCTTCAAAGACTAC

TTTAAAAATAGAGCGAACTGCTTTAGCGCCGACGATATTAGTTCTTCCTCATGCCACAGG

-continued

ATTGTCAACGATAATGCAGAGATATTCTTTTCTAACGCACTAGTCTACAGAAGGATTGTA
AAGTCTTTGTCAAATGATGACATAAACAAGATTAGTGGAGATATGAAAGACTCTCTAAAG
GAAATGAGCCTTGAGGAGATATACTCTTATGAAAAGTACGGTGAGTTTATTACCCAAGAA
GGCATTAGTTTCTATAATGACATTTGTGGAAAAGTTAACAGTTTTATGAATCTATACTGT
CAAAAAAATAAGGAGAATAAAAATCTTTATAAGTTGCAAAAACTGCATAAGCAGATATTA
TGTATAGCAGACACGAGCTATGAGGTACCGTACAAGTTCGAGAGCGATGAGGAAGTCTAC
CAATCTGTCAACGGATTTTTGGACAACATTTCTTCAAAACATATTGTGGAGAGGCTTAGG
AAAATAGGCGACAATTATAATGGATATAACTTAGATAAGATATATATTGTTTCCAAATTC
TACGAATCTGTAAGCCAGAAGACATACAGAGATTGGGAAACGATAAACACAGCCCTTGAA
ATTCACTATAACAACATACTACCTGGAAACGGCAAATCAAAGGCCGACAAAGTTAAGAAG
GCCGTAAAGAATGATTTACAGAAGAGCATAACGGAGATCAATGAGCTGGTGTCTAACTAT
AAATTGTGTAGCGATGACAACATAAAAGCCGAGACTTACATTCACGAAATTTCACACATA
CTTAACAACTTTGAAGCTCAGGAATTAAAGTATAATCCCGAAATACACCTTGTGGAGTCC
GAACTAAAGGCTAGTGAGCTTAAGAACGTCCTAGACGTAATTATGAATGCCTTCCACTGG
TGTAGTGTTTTTATGACCGAGGAACTTGTTGACAAAGATAATAATTTTTATGCAGAACTA
GAAGAGATATACGATGAAATATACCCGGTGATCAGTTTGTACAATCTTGTCAGGAACTAT
GTGACACAAAAGCCCTATTCAACAAAGAAAATAAAACTTAATTTCGGAATTCCTACGTTA
GCTGATGGCTGGTCTAAATCCAAGGAATACAGCAACAACGCTATAATTCTGATGAGAGAT
AACTTGTACTATCTAGGCATCTTCAATGCCAAAAATAAGCCTGATAAGAAGATTATAGAG
GGCAACACTTCAGAGAACAAGGGCGACTACAAGAAAATGATCTATAACCTATTGCCTGGC
CCAAACAAGATGATTCCGAAGGTCTTCCTATCATCCAAGACCGGCGTTGAGACATACAAG
CCATCAGCGTATATTTTAGAGGGGTACAAACAAAACAAGCACATAAAGTCTAGTAAAGAC
TTCGATATAACATTTTGTCATGACTTAATTGACTACTTTAAGAATTGCATCGCTATACAC
CCGGAATGGAAGAATTTCGGCTTCGACTTCTCTGATACATCTACCTACGAGGACATTAGC
GGGTTTTACCGTGAAGTCGAATTACAAGGGTATAAGATAGATTGGACGTACATCTCTGAG
AAAGACATAGACTTGCTTCAGGAAAAGGGCCAGTTGTATCTATTCCAAATATACAATAAG
GATTTTTCCAAGAAATCTACGGGTAATGACAATCTTCACACAATGTATCTTAAGAACCTT
TTCTCAGAAGAGAACCTGAAGGACATTGTCTTAAAACTAAATGGCGAAGCTGAGATTTTT
TTCAGGAAGTCTTCAATTAAGAACCCGATAATCCACAAGAAGGGGAGTATTCTTGTGAAT
AGAACTTACGAGGCCGAAGAAAAAGACCAATTTGGTAACATCCAGATAGTCAGAAAGAAC
ATTCCAGAGAACATCTACCAAGAGCTATACAAATATTTCAACGACAAGTCCGATAAGGAA
CTGTCCGATGAGGCAGCCAAGTTGAAGAATGTCGTGGGTCATCATGAAGCTGCTACTAAC
ATTGTCAAGGACTATCGTTATACTTACGACAAGTATTTCCTACACATGCCGATAACAATT
AATTTCAAGGCTAACAAAACAGGCTTTATCAACGATCGTATCTTGCAGTACATAGCTAAG
GAAAAGGATTTGCATGTGATTGGCATTGATAGAGGGGAGCGTAACTTGATATATGTGTCT
GTCATAGACACGTGTGGCAACATCGTCGAACAGAAATCATTCAACATAGTAAACGGCTAC
GATTACCAAATTAAGCTGAAACAGCAAGAGGGTGCACGTCAAATTGCGCGTAAAGAGTGG
AAAGAAATTGGTAAAATCAAGGAAATTAAAGAAGGCTACTTGTCTCTTGTTATACATGAA
ATTTCCAAGATGGTTATAAAGTATAACGCGATAATTGCTATGGAAGACTTATCATACGGG
TTTAAAAAGGGGAGGTTCAAGGTAGAGAGGCAGGTCTATCAAAAGTTCGAGACGATGTTG

-continued

ATTAATAAACTAAACTATCTAGTGTTCAAAGATATCAGCATTACGGAGAACGGGGGGCTA

CTGAAAGGATATCAACTAACGTACATTCCCGATAAGTTAAAGAACGTTGGTCATCAATGT

GGTTGCATCTTCTACGTGCCTGCTGCCTATACGTCCAAAATAGATCCAACTACTGGATTT

GTTAACATCTTTAAATTCAAAGATTTAACCGTAGACGCCAAAAGGGAATTTATAAAAAAA

TTTGACAGCATCCGTTACGATAGCGAAAAGAATCTGTTCTGTTTTACTTTCGACTACAAT

AATTTCATCACGCAAAATACGGTAATGTCTAAGTCAAGTTGGAGCGTCTACACGTATGGA

GTCAGGATCAAGAGGCGTTTCGTAAATGGAAGATTCTCTAATGAGTCAGATACTATAGAC

ATCACGAAAGATATGGAGAAAACCTTGGAGATGACGGATATTAACTGGCGTGATGGACAC

GATTTAAGACAGGACATTATTGACTATGAGATTGTGCAACACATCTTCGAAATATTCCGT

CTAACAGTCCAAATGAGGAATAGCCTAAGTGAATTGGAGGACCGTGATTACGATAGGCTT

ATAAGTCCTGTCCTTAACGAAAACAATATTTTCTATGATAGTGCTAAGGCGGGGGACGCA

CTGCCTAAAGACGCAGATGCTAACGGGGCATACTGCATTGCGTTAAAGGGTCTGTACGAA

ATCAAGCAGATTACGGAAAACTGGAAAGAGGATGGCAAGTTTAGCAGAGATAAGTTGAAG

ATAAGTAACAAAGATTGGTTTGACTTTATTCAGAATAAAAGGTATTTAAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 100

CCAGCGGCTAAAAAAAAGAAACTGGATGGCAGCGTGGATATGAATAACGGCACTAATAAT

TTCCAGAATTTCATCGGCATTAGCAGCTTACAAAAGACGTTGAGGAATGCCTTAATACCC

ACAGAAACTACTCAACAATTTATAGTGAAGAATGGGATAATTAAGGAAGACGAGTTGAGA

GGTGAAAATAGGCAAATCTTGAAAGACATTATGGATGACTACTACAGGGGCTTCATTAGT

GAAACGTTGTCTTCAATAGATGACATTGATTGGACTTCTTTGTTTGAGAAGATGGAAATA

CAGTTAAAGAACGGCGACAATAAGGATACACTTATCAAAGAGCAAACAGAATATAGAAAA

GCAATTCACAAAAAGTTTGCTAACGATGATAGGTTCAAGAACATGTTTAGCGCTAAACTA

ATATCAGACATCCTTCCCGAGTTCGTTATTCATAACAATAACTATAGTGCAAGTGAAAAA

GAGGAGAAGACACAGGTGATTAAGCTGTTCTCCAGATTCGCGACTTCTTTCAAAGATTAC

TTCAAAAACAGAGCCAACTGTTTTTCAGCTGACGATATCTCTAGTAGTAGTTGTCACCGT

ATAGTGAACGATAACGCTGAGATCTTCTTTAGCAATGCATTAGTGTATAGAAGGATAGTT

AAGTCTCTAAGCAATGATGATATCAATAAAATTTCCGGAGACATGAAGGACTCCCTAAAG

GAAATGTCCTTAGAAGAGATCTACTCATATGAGAAATACGGGGAATTTATTACGCAGGAA

GGGATCTCCTTTTACAATGACATATGCGGGAAGGTCAACTCTTTCATGAACTTATACTGC

CAAAAGAACAAGGAGAACAAGAATTTATATAAACTTCAGAAACTTCACAAACAAATACTG

TGCATAGCCGATACCTCATATGAGGTTCCTTACAAATTTGAATCAGATGAAGAGGTATAC

CAATCCGTTAACGGCTTTCTTGACAATATTAGCTCAAAGCACATCGTGGAGAGGTTGAGA

AAGATTGGTGATAATTATAATGGCTACAATCTAGATAAGATATATATTGTTAGCAAGTTC

TACGAGTCTGTGTCCCAAAAAACATATAGGGATTGGGAGACAATTAATACTGCTCTAGAA

ATCCATTACAACAACATCCTTCCTGGAAATGGCAAGAGTAAGGCCGACAAAGTCAAGAAA

GCAGTGAAAAATGATCTGCAAAAATCAATTACTGAGATAAACGAGCTAGTATCTAATTAC

AAGCTTTGTAGCGACGATAACATTAAGGCAGAAACGTACATACACGAGATTAGTCACATC

TTAAATAATTTTGAAGCCCAAGAACTGAAATATAACCCTGAGATACACCTTGTTGAATCC

GAGTTAAAGGCGTCTGAACTAAAAAACGTGTTAGACGTTATTATGAATGCCTTCCACTGG

-continued

TGTAGCGTCTTTATGACTGAGGAGTTGGTTGATAAGGATAATAACTTTTACGCTGAATTG

GAAGAAATTTATGACGAAATCTATCCTGTTATTTCTCTATATAATTTGGTGAGAAATTAC

GTAACGCAAAAGCCCTATAGTACGAAAAAAATAAAACTAAATTTCGGGATCCCTACCCTA

GCCGACGGTTGGTCTAAATCCAAGGAGTACTCAAACAATGCAATAATATTGATGAGGGAC

AACCTGTACTACCTAGGCATATTTAATGCCAAAAATAAGCCCGATAAAAAGATTATAGAA

GGGAACACGTCAGAAAATAAAGGAGACTATAAGAAAATGATCTACAACCTTTTGCCCGGC

CCCAATAAAATGATCCCGAAGGTCTTCCTAAGTAGCAAGACTGGCGTAGAGACCTACAAA

CCATCTGCATACATTTTGGAGGGGTACAAGCAAAACAAGCACATAAAGAGTAGTAAGGAT

TTTGACATTACATTCTGCCATGACTTAATTGACTACTTTAAAAATTGCATCGCAATTCAC

CCTGAATGGAAAAATTTTGGATTTGATTTCTCTGATACTTCAACATATGAGGATATTTCA

GGGTTCTACAGGGAGGTCGAACTACAGGGTTACAAAATAGACTGGACGTATATTTCTGAG

AAAGATATAGATTTGCTTCAGGAAAAGGGTCAGCTATATCTGTTCCAGATATATAATAAG

GACTTCTCCAAAAAGAGTACCGGAAATGATAATCTGCACACAATGTACTTAAAAAACTTG

TTCTCTGAGGAGAATCTAAAAGACATCGTACTAAAACTTAACGGGGAGGCCGAAATTTTT

TTTAGGAAGTCCAGCATCAAGAACCCGATTATTCATAAAAAAGGTAGCATTTTGGTGAAC

CGTACTTATGAGGCGGAAGAAAAAGACCAATTCGGTAATATTCAAATCGTTAGAAAGAAC

ATCCCTGAGAACATTTATCAGGAACTATACAAATACTTTAACGACAAATCAGATAAGGAG

CTTTCTGATGAGGCAGCTAAATTGAAAAATGTAGTGGGACATCACGAAGCAGCCACTAAC

ATAGTGAAGGACTACAGATACACATACGATAAGTACTTCCTGCACATGCCTATTACAATT

AACTTTAAAGCAAATAAAACAGGGTTTATTAACGACAGAATCTTACAGTATATTGCCAAA

GAAAAGGATCTGCATGTGATAGGAATAGACAGAGGAGAAAGAAACCTGATATACGTCTCC

GTGATTGATACATGTGGGAACATAGTAGAACAGAAGTCCTTTAACATTGTTAATGGGTAC

GATTATCAAATTAAATTAAAACAACAAGAAGGAGCACGTCAAATAGCTAGGAAAGAATGG

AAAGAGATAGGAAAAATTAAGGAAATTAAGGAGGGTTACCTGTCCCTTGTAATTCATGAA

ATATCCAAAATGGTAATTAAATATAACGCGATCATCGCGATGGAAGATCTAAGCTACGGG

TTCAAAAAAGGCAGGTTTAAGGTGGAGAGGCAAGTTTACCAAAAGTTCGAGACAATGTTG

ATTAATAAGTTAAACTACTTAGTTTTCAAAGATATCTCCATAACCGAGAATGGCGGGCTT

TTAAAAGGGTACCAACTAACATATATCCCGGATAAATTGAAGAACGTTGGACACCAGTGT

GGCTGCATATTTTATGTACCCGCTGCGTATACTTCTAAAATTGACCCGACCACCGGGTTT

GTAAACATATTCAAGTTTAAGGACCTAACAGTTGACGCCAAACGTGAGTTCATCAAGAAG

TTCGATAGTATAAGGTATGACTCTGAGAAGAACCTTTTCTGCTTCACGTTTGACTATAAT

AATTTCATCACCCAAAATACAGTTATGTCAAAAAGCTCTTGGTCAGTATATACGTATGGC

GTAAGGATTAAGCGTAGGTTCGTGAACGGTAGATTTTCCAACGAGTCAGATACTATTGAT

ATTACCAAGGATATGGAGAAGACATTAGAAATGACAGATATAAATTGGAGGGATGGGCAC

GATCTAAGGCAAGATATCATTGATTACGAAATTGTTCAGCACATATTCGAGATATTCCGT

CTTACAGTACAAATGCGTAACAGCTTGTCTGAGTTGGAAGATCGTGACTATGACAGGTTG

ATATCACCGGTCTTGAACGAGAACAATATATTCTACGACAGCGCTAAGGCGGGAGACGCT

CTGCCTAAAGACGCAGATGCCAATGGGGCGTACTGCATTGCCTTAAAAGGCTTATACGAG

ATTAAACAGATCACAGAGAACTGGAAAGAGGACGGCAAGTTTTCTAGAGATAAATTGAAA

ATCTCAAACAAAGACTGGTTCGATTTCATCCAAAACAAAAGATACCTTAAACGTCCGGCA

-continued

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 101
CCAGCGGCTAAAAAAAAGAAACTGGATGGCAGCGTGGATATGAACAATGGAACTAACAAC

TTCCAGAACTTTATCGGCATCTCTTCCCTCCAAAAGACACTGAGAAATGCACTGATCCCA

ACCGAAACGACTCAACAATTTATTGTTAAGAACGGCATCATAAAAGAAGACGAGCTTCGC

GGCGAGAACCGCCAGATACTTAAGGATATTATGGACGATTATTACCGAGGCTTTATCAGC

GAAACTCTTAGCTCTATTGATGATATCGACTGGACCTCCCTCTTCGAAAAAATGGAGATA

CAGCTCAAGAACGGCGATAATAAAGACACCTTGATAAAGGAACAGACTGAGTACAGGAAA

GCGATCCACAAGAAATTCGCGAACGACGACAGGTTTAAAAACATGTTCTCTGCAAAATTG

ATATCCGACATCTTGCCGGAATTTGTGATACACAACAATAACTATAGCGCTTCAGAGAAA

GAAGAGAAGACCCAAGTAATCAAGTTGTTCAGCCGCTTCGCAACGTCTTTTAAAGATTAC

TTTAAGAACCGGGCCAATTGTTTCTCCGCGGATGATATTAGCTCATCAAGTTGCCATCGA

ATTGTCAATGATAATGCGGAGATCTTCTTCAGCAATGCGCTGGTCTACAGACGAATCGTA

AAAAGTCTTTCAAATGACGACATCAATAAGATTAGTGGAGATATGAAGGATTCCCTTAAG

GAAATGAGTCTTGAAGAAATATACTCATACGAAAAGTACGGGGAATTTATTACCCAGGAG

GGGATCTCCTTCTATAACGACATCTGTGGAAAAGTAAACTCATTCATGAACCTGTACTGT

CAGAAAAACAAAGAAAACAAAAATCTGTATAAACTCCAAAAATTGCACAAGCAAATATTG

TGTATAGCGGACACATCATACGAGGTTCCATATAAGTTCGAAAGTGATGAAGAAGTCTAC

CAATCAGTGAATGGGTTTCTGGACAACATTAGTTCCAAGCACATAGTTGAACGACTGCGA

AAGATTGGTGACAATTACAACGGCTATAATTTGGACAAGATTTATATAGTTAGCAAATTT

TATGAATCCGTATCACAAAAGACTTATAGAGACTGGGAAACAATCAACACGGCACTTGAG

ATCCATTATAACAATATTCTTCCAGGGAACGGCAAAAGCAAGGCTGATAAGGTAAAAAAG

GCCGTTAAGAATGATCTTCAAAAATCCATAACGGAGATCAACGAACTTGTAAGTAACTAC

AAATTGTGCTCTGACGACAATATAAAGGCTGAAACGTATATTCACGAGATTAGCCATATC

CTGAATAACTTTGAGGCCCAAGAACTCAAGTATAACCCGGAAATACATTTGGTAGAAAGC

GAGCTTAAAGCGAGTGAGCTGAAAAACGTCCTCGATGTGATCATGAATGCTTTCCACTGG

TGTAGTGTCTTTATGACTGAGGAGTTGGTTGATAAAGACAATAATTTCTACGCTGAACTG

GAAGAAATTTACGACGAAATCTATCCAGTGATCTCCCTCTATAACCTCGTTCGAAACTAC

GTGACGCAGAAACCTTATTCTACAAAGAAAATTAAGTTGAACTTCGGCATTCCTACACTT

GCTGACGGATGGTCCAAATCCAAAGAGTACTCAAACAACGCAATCATCCTCATGCGGGAT

AACCTTTATTATATTTGGGCATTTTCAACGCCAAAAACAAACCTGATAAAAAGATAATTGAA

GGCAATACGAGTGAGAACAAGGGCGACTACAAAAAAATGATATATAACTTGTTGCCAGGC

CCCAACAAGATGATTCCTAAAGTTTTTCTGTCTTCTAAGACTGGAGTTGAAACTTACAAA

CCCTCCGCCTACATTCTTGAAGGGTATAAACAGAATAAGCACATAAAGTCCTCAAAGGAT

TTCGACATTACGTTTTGCCATGACCTCATCGACTATTTCAAGAACTGTATCGCCATACAT

CCGGAGTGGAAGAATTTTGGATTTGATTTCTCCGACACATCTACCTATGAAGACATAAGC

GGTTTCTACCGGGAGGTCGAGCTTCAGGGCTATAAGATAGATTGGACATACATTAGTGAA

AAAGATATCGATCTTCTGCAAGAAAAGGGACAACTTTACCTTTTTCAGATTTATAATAAA

GACTTTTCAAAAAAGTCCACAGGGAACGATAATCTGCACACCATGTATCTCAAGAATCTG

TTTAGTGAAGAAAACCTTAAAGACATAGTTTTGAAGCTTAACGGAGAGGCTGAGATTTTT

-continued

TTTAGAAAGTCCTCAATTAAAAACCCTATAATACACAAGAAAGGCTCTATTCTTGTTAAC

AGGACATATGAAGCCGAGGAGAAAGATCAGTTTGGCAATATCCAGATTGTTCGCAAGAAT

ATCCCGGAAAATATATATCAGGAGCTGTATAAATACTTTAACGACAAGAGCGACAAGGAG

CTGAGTGACGAGGCCGCGAAGCTTAAGAATGTAGTAGGTCACCACGAAGCAGCCACCAAT

ATCGTCAAAGACTATAGGTACACGTACGACAAGTACTTTTTGCACATGCCTATAACTATA

AACTTCAAAGCTAATAAAACTGGGTTTATTAATGACAGGATTCTCCAATACATCGCTAAA

GAGAAGGATCTGCATGTAATTGGCATAGACAGAGGTGAGAGAAACTTGATATATGTCAGC

GTAATAGACACATGTGGCAATATCGTGGAACAGAAGTCTTTTAACATCGTCAATGGTTAC

GACTACCAAATTAAGTTGAAACAGCAGGAAGGCGCACGACAGATCGCACGAAAGGAATGG

AAAGAGATAGGCAAAATAAAAGAAATAAAGGAGGGCTATCTCAGTCTCGTTATACACGAA

ATTTCAAAAATGGTTATTAAGTACAATGCAATCATAGCGATGGAGGATCTCAGTTATGGG

TTCAAAAAGGGTCGGTTTAAAGTTGAGCGCCAAGTGTACCAAAAGTTCGAGACAATGCTG

ATTAACAAGCTGAACTACCTCGTCTTCAAAGATATAAGTATTACGGAGAACGGTGGCCTT

CTTAAAGGCTATCAACTTACTTACATCCCGGACAAGCTCAAAAACGTAGGGCACCAATGC

GGGTGTATTTTCTATGTGCCTGCGGCATATACGTCAAAGATTGACCCAACCACAGGATTC

GTAAACATATTCAAGTTTAAGGACCTCACCGTTGATGCGAAAAGGGAGTTCATTAAAAAA

TTTGATTCTATTCGATATGATAGTGAGAAAAATCTCTTTTGTTTCACATTTGACTATAAT

AATTTTATTACTCAGAATACTGTCATGAGCAAGTCATCTTGGTCAGTGTACACATACGGG

GTGCGGATCAAACGCAGGTTCGTCAATGGTCGCTTCTCAAACGAATCAGACACCATTGAC

ATCACAAAGGACATGGAAAAAACCCTTGAGATGACCGACATTAATTGGCGCGATGGTCAT

GATCTGCGGCAAGACATCATAGACTACGAAATCGTCCAACACATCTTTGAGATCTTTCGC

TTGACGGTCCAAATGCGGAACTCCCTGTCCGAGCTCGAGGATAGAGATTATGATCGGCTG

ATATCTCCCGTGCTTAATGAAAATAACATCTTCTACGACTCCGCCAAGGCGGGTGATGCC

CTGCCGAAGGATGCGGATGCTAATGGCGCTTATTGCATTGCTCTTAAGGGGCTCTATGAG

ATAAAGCAGATCACGGAAAACTGGAAAGAAGACGGTAAGTTTAGTAGAGACAAGCTGAAG

ATCTCAAATAAAGACTGGTTTGATTTCATACAGAACAAGCGGTACCTGAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 102
CCAGCGGCTAAAAAAAAGAAACTGGATGGCAGCGTGGATATGAACAATGGCACTAACAAT

TTTCAGAATTTCATCGGCATTTCAAGTCTGCAAAAAACTCTGAGGAATGCTTTGATCCCT

ACTGAAACCACTCAGCAATTTATAGTCAAGAACGGTATAATTAAAGAAGATGAACTCAGG

GGTGAAAATAGACAAATACTCAAGGACATTATGGATGACTATTATAGAGGCTTCATCTCA

GAGACTCTCTCATCAATAGATGATATCGATTGGACTAGCCTTTTCGAGAAAATGGAGATT

CAGTTGAAAAATGGTGATAACAAAGATACGTTGATAAAGGAACAGACCGAGTACAGGAAA

GCCATTCATAAGAAATTTGCTAATGACGATAGATTTAAGAATATGTTTAGTGCAAAACTG

ATTAGTGACATTCTGCCGGAGTTCGTTATCCATAATAATAACTACTCTGCATCCGAAAAG

GAGGAAAAGACGCAAGTTATTAAACTGTTCAGCCGCTTCGCCACAAGCTTCAAGGACTAC

TTCAAAAATAGAGCCAACTGCTTTTCTGCCGACGATATATCATCATCTTCATGCCATCGG

ATCGTTAACGATAACGCCGAGATATTCTTCAGCAACGCCCTTGTATATCGAAGAATAGTC

-continued

AAAAGTCTGAGTAATGATGATATTAATAAAATTAGCGGTGATATGAAAGACTCCCTGAAG

GAAATGTCACTGGAGGAAATTTATAGTTACGAAAAGTACGGCGAATTCATTACTCAAGAA

GGCATATCCTTCTATAACGACATTTGCGGAAAGGTCAACTCATTCATGAACCTTTATTGC

CAGAAGAATAAGGAGAATAAAAATCTTTACAAATTGCAAAAACTTCACAAACAAATTCTT

TGCATCGCGGATACGTCCTACGAAGTTCCTTACAAATTTGAATCCGATGAGGAAGTGTAT

CAGAGTGTCAATGGATTTTTGGATAATATCTCTTCAAAACATATTGTGGAGAGATTGCGC

AAAATAGGTGATAACTACAATGGCTACAACCTGGACAAGATTTATATTGTTAGCAAGTTC

TATGAAAGTGTCAGTCAAAAGACCTACAGAGATTGGGAGACAATCAACACGGCGCTCGAA

ATACACTACAATAACATCCTCCCCGGCAATGGGAAGAGTAAAGCCGATAAGGTTAAAAAA

GCTGTTAAGAACGACCTCCAGAAATCCATCACGGAAATAAACGAGCTGGTTTCCAACTAT

AAGCTGTGTAGCGATGATAATATTAAGGCTGAGACATATATACATGAGATCAGCCACATT

CTCAACAATTTCGAGGCACAGGAACTCAAATACAATCCCGAGATTCACTTGGTGGAAAGT

GAGTTGAAGGCGTCAGAGCTTAAGAATGTACTTGACGTAATAATGAATGCTTTTCATTGG

TGCTCCGTGTTCATGACTGAGGAACTCGTGGATAAGGATAATAACTTTTATGCGGAGTTG

GAAGAGATATACGATGAAATATACCCGGTTATCTCACTGTATAATCTGGTCAGAAATTAC

GTGACCCAAAAGCCTTATAGTACAAAAAAAATAAAGTTGAACTTCGGTATTCCGACATTG

GCAGATGGTTGGTCCAAAAGCAAAGAATACTCTAATAACGCCATTATATTGATGCGAGAC

AATTTGTATTACCTTGGGATCTTTAACGCGAAAAACAAACCGGATAAGAAGATCATCGAA

GGTAATACATCTGAGAATAAGGGGGATTACAAGAAGATGATTTATAATCTGTTGCCGGGG

CCAAACAAGATGATTCCGAAGGTCTTTCTGTCATCTAAGACAGGAGTAGAGACCTACAAA

CCTTCTGCGTACATTTTGGAAGGCTACAAACAGAACAAGCATATAAAATCTAGCAAGGAC

TTTGATATCACGTTTTGTCATGATCTGATAGATTATTTCAAAAACTGCATCGCTATACAT

CCTGAGTGGAAGAATTTCGGCTTTGACTTTTCTGACACCAGCACATACGAAGACATCTCA

GGTTTCTACCGGGAAGTCGAGCTCCAGGGGTACAAGATTGACTGGACATATATAAGTGAA

AAAGACATCGACCTCCTCCAAGAGAAGGGCCAACTTTACCTGTTCCAGATCTATAACAAA

GACTTTTCTAAAAAGTCCACGGGTAACGACAACTTGCACACTATGTATCTGAAAAACTTG

TTCTCTGAAGAGAACCTCAAGGACATCGTCCTGAAGCTTAACGGGGAGGCGGAGATCTTC

TTTAGAAAGTCCTCTATCAAAAATCCCATTATCCATAAAAAGGGCTCTATACTCGTTAAT

AGGACATATGAAGCGGAGGAAAAAGATCAATTTGGGAACATCCAGATCGTCCGGAAAAAT

ATACCTGAGAATATCTATCAAGAGCTGTACAAGTATTTTAATGATAAGTCAGACAAAGAG

CTCAGTGATGAGGCGGCAAAGCTCAAGAACGTGGTGGGGCATCATGAAGCTGCGACGAAC

ATTGTCAAAGATTATAGATACACTTACGATAAATACTTCCTCCACATGCCGATAACGATT

AACTTCAAAGCCAATAAGACGGGGTTTATAAATGATCGGATCCTTCAGTACATTGCGAAA

GAGAAAGACCTCCATGTGATCGGAATTGACCGAGGAGAAAGGAATCTGATTTACGTGTCC

GTGATTGATACTTGCGGGAATATAGTCGAGCAAAAGAGTTTCAACATAGTCAACGGGTAT

GACTATCAGATAAAGCTCAAACAGCAGGAAGGTGCGAGGCAAATTGCGCGCAAAGAGTGG

AAGGAGATAGGCAAGATTAAAGAAATCAAGGAAGGTTATCTCAGCTTGGTGATCCATGAA

ATATCTAAGATGGTTATAAAGTACAATGCCATAATAGCCATGGAGGATCTTTCCTACGGG

TTTAAGAAGGGCCGATTTAAAGTGGAGCGACAAGTTTACCAGAAGTTCGAAACCATGTTG

ATTAACAAACTTAACTATTTGGTGTTCAAGGATATAAGTATAACCGAAAACGGCGGTTTG

CTTAAGGGTTATCAGCTCACGTATATTCCTGATAAACTTAAAAACGTTGGACACCAGTGT

-continued

GGATGTATCTTCTACGTGCCAGCCGCTTACACTAGTAAGATAGATCCTACCACGGGGTTT

GTGAATATTTTTAAGTTTAAAGACTTGACAGTCGACGCCAAAAGGGAATTTATAAAAAAG

TTTGATTCTATCCGCTACGATAGTGAAAAAAATCTCTTTTGCTTTACTTTCGACTATAAC

AACTTCATTACGCAGAACACTGTCATGAGTAAGTCCAGCTGGAGCGTCTACACATATGGC

GTCCGAATTAAACGACGATTTGTAAACGGGCGGTTTTCAAACGAATCTGACACGATAGAC

ATTACCAAGGATATGGAGAAGACACTTGAGATGACCGACATAAACTGGCGGGACGGTCAC

GATCTTCGGCAGGACATAATTGATTACGAAATCGTCCAGCATATATTCGAAATATTTCGA

CTTACAGTGCAAATGCGGAACAGTCTCTCTGAACTGGAAGATCGCGATTATGACCGGTTG

ATTTCTCCGGTCCTCAATGAAAATAACATATTTTATGATAGTGCTAAGGCAGGTGATGCG

TTGCCAAAGGATGCAGACGCTAATGGTGCCTATTGTATCGCGCTCAAGGGATTGTACGAG

ATAAAGCAAATTACGGAGAACTGGAAGGAGGATGGTAAGTTTAGCCGAGACAAGTTGAAG

ATTAGCAATAAAGACTGGTTTGATTTTATCCAAAACAAGAGGTACCTGAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 103
CCAGCGGCTAAAAAAAAGAAACTGGATGGCAGCGTGGATATGAATAACGGAACTAATAAC

TTTCAAAATTTCATAGGTATTTCAAGCTTGCAGAAGACCCTGAGGAATGCCCTGATTCCA

ACCGAGACAACGCAGCAGTTCATAGTCAAAAATGGCATTATTAAGGAAGATGAGCTGCGG

GGGGAAAACCGACAGATACTCAAGGATATTATGGACGACTATTACCGGGGATTTATCTCA

GAAACGCTGAGCAGTATTGATGACATCGATTGGACCAGTCTTTTCGAGAAAATGGAAATT

CAACTTAAGAATGGTGACAATAAAGACACTCTCATAAAGGAGCAAACTGAATACCGAAAA

GCCATACACAAAAAGTTTGCCAACGATGACCGCTTTAAAAACATGTTTTCAGCTAAGCTC

ATTAGCGACATTCTCCCCGAGTTTGTGATTCATAACAATAACTATAGCGCATCCGAGAAG

GAGGAAAAAACCCAAGTTATCAAATTGTTCAGTAGATTCGCTACGAGCTTTAAAGATTAC

TTTAAAAACCGGGCTAACTGCTTCAGTGCAGACGATATCAGCTCCTCATCCTGTCATCGC

ATCGTCAATGATAATGCTGAGATCTTCTTTTCTAATGCACTGGTTTACCGCAGGATAGTT

AAGTCTCTTAGTAACGACGACATCAACAAGATATCAGGAGATATGAAGGATTCCCTTAAA

GAAATGAGTCTCGAGGAGATATATTCTTATGAAAAATACGGCGAATTTATTACCCAAGAG

GGCATTAGTTTCTATAATGACATATGCGGAAAAGTTAATAGTTTTATGAATCTCTATTGT

CAGAAGAATAAGGAGAATAAGAACCTCTACAAATTGCAGAAGTTGCACAAGCAAATTCTG

TGTATCGCGGACACCTCTTACGAGGTCCCATATAAGTTCGAGAGTGATGAAGAAGTATAC

CAGAGCGTTAATGGGTTCCTGGACAACATCTCAAGTAAACACATAGTCGAAAGGCTCCGA

AAGATCGGTGATAACTATAACGGATATAATTTGGATAAAATTTATATAGTTAGCAAATTT

TACGAGAGCGTCAGTCAGAAGACCTACCGGGACTGGGAGACCATAAACACAGCGCTGGAA

ATACATTATAACAACATACTGCCTGGGAACGGTAAGTCAAAGGCAGACAAGGTTAAAAAG

GCTGTGAAGAATGACCTGCAAAAATCAATTACAGAAATAAATGAGTTGGTAAGTAATTAC

AAACTTTGCAGCGATGATAATATAAAGGCAGAGACGTACATACATGAAATATCTCATATC

CTCAACAATTTCGAAGCCCAAGAACTGAAGTACAACCCGGAAATTCATCTTGTAGAGTCT

GAGTTGAAGGCCTCCGAATTGAAAAACGTTCTTGACGTAATTATGAATGCCTTCCACTGG

TGCTCAGTATTCATGACGGAAGAGCTCGTGGATAAAGACAACAATTTTTACGCTGAACTG

-continued

```
GAAGAAATATATGACGAGATTTACCCCGTAATTTCACTCTACAACTTGGTACGAAATTAC
GTTACCCAAAAGCCATACTCAACAAAAAAAATTAAACTGAACTTCGGGATACCCACCCTC
GCAGATGGATGGTCAAAGTCCAAAGAGTACAGTAACAATGCAATTATCCTGATGCGAGAC
AACCTTTATTACCTCGGGATTTTCAACGCTAAAAATAAACCTGATAAAAAAATAATTGAG
GGTAATACCTCTGAAAACAAGGGGGATTATAAAAAGATGATATACAATCTGCTGCCTGGC
CCGAACAAAATGATTCCTAAAGTCTTCTTGTCTTCCAAGACTGGAGTCGAAACCTACAAG
CCAAGTGCTTATATACTCGAAGGGTACAAACAAAATAAGCACATAAAATCCAGCAAGGAT
TTTGATATTACATTCTGCCACGATTTGATTGATTATTTTAAGAACTGTATAGCCATCCAC
CCAGAATGGAAGAATTTTGGTTTTGATTTTAGCGATACCTCAACATATGAGGATATCTCT
GGCTTTTACCGCGAGGTAGAACTGCAAGGTTATAAGATCGATTGGACTTATATTTCTGAA
AAGGACATAGATCTCCTGCAAGAGAAAGGGCAACTTTATTTGTTTCAAATATACAACAAA
GATTTTAGTAAGAAGAGTACTGGCAATGATAACCTTCACACTATGTATCTGAAGAACCTT
TTTTCTGAGGAGAACTTGAAGGACATAGTCCTTAAACTCAATGGGGAAGCTGAAATATTC
TTTCGCAAAAGCTCCATTAAAAACCCGATCATTCATAAAAAGGGTTCCATCTTGGTAAAC
CGCACATACGAGGCGGAAGAAAAAGATCAGTTCGGAAATATCCAGATCGTAAGGAAGAAT
ATCCCCGAAAATATATACCAAGAGCTTTACAAATATTTTAACGATAAGTCAGACAAGGAA
CTGTCAGACGAAGCAGCCAAGTTGAAGAATGTCGTAGGGCACCACGAAGCAGCTACAAAC
ATAGTTAAAGATTATCGGTACACCTACGATAAATATTTCCTGCATATGCCAATAACCATA
AACTTCAAAGCCAACAAAACAGGGTTCATCAATGACCGAATACTTCAGTATATAGCCAAG
GAAAAAGACCTGCATGTTATAGGAATAGATAGAGGTGAGCGCAACTTGATATATGTCAGC
GTGATAGACACCTGCGGAAATATCGTCGAGCAAAAAAGTTTCAACATTGTTAATGGCTAC
GATTACCAAATTAAATTGAAGCAGCAAGAGGGGGCTCGGCAAATCGCGCGAAAGGAATGG
AAAGAAATCGGGAAGATTAAAGAAATTAAAGAGGGCTACCTGTCTCTTGTAATTCACGAA
ATATCTAAGATGGTCATCAAGTATAATGCCATTATTGCGATGGAAGATCTGTCCTACGGA
TTTAAGAAAGGCAGGTTTAAAGTCGAAAGGCAGGTGTACCAGAAATTCGAGACCATGCTG
ATTAATAAGCTCAACTATCTCGTATTTAAGGATATTTCTATAACTGAAAATGGAGGGCTT
CTCAAAGGATATCAACTCACATACATACCTGATAAGCTGAAGAACGTAGGCCACCAGTGT
GGATGCATATTCTATGTACCAGCTGCATACACAAGCAAGATCGATCCAACTACTGGGTTT
GTCAATATCTTCAAATTTAAGGACTTGACGGTCGATGCCAAACGGGAGTTCATCAAAAAG
TTTGATAGTATTCGATATGATAGTGAGAAGAACTTGTTTTGCTTCACATTTGACTACAAC
AATTTCATAACGCAAAATACGGTTATGTCTAAATCCTCATGGAGCGTCTACACTTACGGA
GTGAGGATAAAGCGGCGCTTCGTAAATGGCAGGTTTAGCAATGAATCCGACACGATTGAC
ATAACCAAGGATATGGAGAAAACCCTCGAGATGACCGATATAAATTGGCGGGATGGACAC
GATCTGCGACAAGACATAATCGATTATGAAATCGTGCAGCACATATTTGAGATATTCAGG
CTTACGGTCCAAATGAGAAATTCCCTTTCCGAACTTGAAGACCGCGATTACGACCGACTG
ATAAGCCCCGTTCTGAACGAAAATAACATCTTCTACGACAGCGCTAAAGCGGGAGACGCG
CTGCCGAAAGATGCGGACGCAAATGGAGCCTATTGTATCGCCTTGAAAGGGTTGTACGAG
ATCAAACAGATAACCGAGAATTGGAAGGAGGATGGGAAGTTTAGTCGAGACAAACTTAAA
ATAAGCAACAAGGACTGGTTCGACTTTATTCAAAACAAACGATATCTCAAACGTCCGGCA
GCGACCAAAAAAGCCGGCCAGGCGAAGAAAAAAAAAGCGTCAGGTAGCGGCGCAGGCAGC
CCGAAAAAGAAACGTAAAGTCGAGGATCCGAAAAAGAAACGTAAGGTTATTCCGGGCTAA
```

SEQ ID NO: 104
CCAGCGGCTAAAAAAAAGAAACTGGATGGCAGCGTGGATATGAATAATGGTACTAACAAT

TTTCAAAACTTTATCGGCATCTCTTCACTTCAGAAAACTCTTCGGAACGCCCTTATACCG

ACGGAGACAACGCAGCAGTTTATAGTTAAAAACGGGATCATTAAAGAAGATGAACTCAGA

GGGGAAAACAGGCAAATATTGAAGGACATTATGGACGATTACTACCGGGGGTTTATTTCA

GAGACCCTTTCATCTATTGATGACATAGATTGGACCTCCCTTTTCGAGAAAATGGAGATA

CAATTGAAAAACGGCGACAATAAAGATACACTTATCAAGGAACAAACTGAGTATCGCAAG

GCGATTCACAAGAAGTTTGCGAATGACGATCGCTTTAAGAATATGTTTTCTGCGAAGCTC

ATAAGTGACATTCTGCCTGAATTTGTCATTCATAACAACAATTATTCTGCTAGCGAAAAA

GAGGAAAAAACTCAAGTCATTAAGCTTTTTAGCAGGTTCGCTACTAGTTTTAAAGACTAT

TTTAAGAACCGGGCGAATTGCTTTAGCGCTGACGACATATCATCCTCATCCTGTCATCGC

ATAGTCAATGATAATGCAGAAATATTCTTTTCTAATGCGCTCGTGTATCGGAGAATAGTG

AAAAGCCTCTCTAACGATGACATTAACAAAATAAGCGGCGATATGAAGGATAGTCTGAAG

GAAATGTCCCTCGAAGAAATATACTCATACGAGAAGTACGGAGAATTTATCACCCAGGAA

GGAATTAGTTTTTACAACGACATCTGTGGTAAGGTTAACTCTTTTATGAATCTGTATTGT

CAAAAGAATAAAGAAAATAAAAATCTTTATAAGCTCCAAAAGCTTCACAAACAAATCTTG

TGCATTGCGGATACGTCATACGAAGTACCTTACAAATTTGAAAGCGACGAAGAGGTGTAT

CAGTCAGTGAATGGGTTCCTTGACAATATTTCTAGCAAACATATTGTGGAGCGACTTCGA

AAGATCGGTGATAATTACAATGGCTATAATTTGGATAAAATTTACATAGTTAGTAAGTTT

TATGAATCCGTCTCACAAAAGACGTACCGAGATTGGGAGACCATCAACACTGCTCTGGAG

ATTCATTACAATAATATATTGCCTGGGAATGGGAAGTCAAAGGCCGACAAGGTTAAAAAA

GCCGTAAAAAACGATCTTCAAAAGTCCATTACCGAGATAAATGAACTTGTATCCAACTAT

AAGTTGTGCTCTGACGATAATATTAAAGCAGAAACGTATATCCACGAAATAAGTCACATC

CTGAACAACTTCGAAGCTCAAGAGCTCAAGTATAATCCTGAAATTCATCTCGTCGAAAGC

GAGCTGAAAGCATCCGAGTTGAAGAATGTGCTTGATGTGATCATGAACGCATTCCATTGG

TGCAGTGTGTTCATGACCGAAGAACTTGTAGACAAAGACAACAACTTCTACGCTGAATTG

GAAGAGATTTACGATGAAATTTACCCCGTGATATCCCTCTATAATCTGGTAAGAAATTAC

GTCACGCAAAAACCATACAGTACCAAGAAAATAAAGCTCAACTTTGGTATTCCGACGTTG

GCAGATGGGTGGAGTAAGAGCAAGGAGTATTCTAACAATGCAATCATCCTCATGCGCGAC

AATTTGTATTATCTGGGGATCTTCAACGCGAAAAATAAGCCCGACAAAAAGATAATAGAA

GGCAATACGTCCGAGAACAAAGGGGACTATAAGAAAATGATTTATAACCTTCTTCCAGGA

CCCAACAAGATGATCCCAAAGGTTTTCTTGAGTTCAAAAACCGGCGTAGAAACTTATAAA

CCGTCCGCCTACATTCTGGAAGGGTACAAGCAAAACAAGCACATTAAGTCATCTAAGGAT

TTCGACATTACTTTTTGTCATGATTTGATAGACTACTTCAAAAATTGTATAGCGATACAT

CCGGAATGGAAAAATTTTGGGTTCGATTTTTCCGACACAAGTACTTATGAAGACATCTCA

GGGTTTTATAGGGAAGTTGAACTGCAAGGTTACAAAATAGACTGGACTTATATTAGTGAG

AAGGACATTGATTTGCTCCAGGAAAAGGGTCAATTGTATCTGTTCCAGATATATAACAAG

GATTTCTCTAAAAAATCTACAGGTAACGACAATCTCCACACGATGTACCTCAAGAATCTC

TTCAGCGAAGAGAATTTGAAGGATATCGTACTTAAGCTCAATGGAGAAGCGGAAATATTC

TTCAGAAAGTCCAGCATTAAGAATCCTATAATTCACAAGAAAGGGTCAATTCTCGTAAAC

-continued

CGGACTTATGAGGCCGAAGAAAAAGATCAGTTTGGTAACATTCAGATTGTACGGAAAAAC

ATTCCCGAGAACATCTATCAAGAACTGTATAAATACTTTAATGATAAATCCGACAAGGAA

CTTTCTGACGAGGCTGCAAAATTGAAGAACGTAGTGGGACACCATGAGGCCGCAACCAAT

ATAGTAAAGGATTACAGATACACTTATGATAAGTATTTCCTCCATATGCCGATCACGATT

AATTTCAAGGCGAATAAAACCGGCTTCATTAACGATCGCATTTTGCAATATATTGCGAAG

GAAAAGGATTTGCACGTGATAGGTATAGACCGGGGTGAACGAAACTTGATTTACGTCTCT

GTGATCGACACATGCGGAAATATAGTTGAACAGAAGTCCTTTAATATTGTGAATGGTTAC

GACTACCAGATAAAATTGAAGCAACAGGAGGGCGCAAGACAGATAGCTCGCAAAGAGTGG

AAGGAAATCGGCAAGATCAAAGAAATAAAGGAGGGTTATCTTTCCCTGGTAATTCATGAA

ATTAGCAAGATGGTTATTAAGTATAATGCTATAATAGCTATGGAGGACCTTTCCTATGGG

TTCAAGAAAGGTCGCTTCAAAGTGGAGCGACAAGTGTATCAAAAGTTCGAGACTATGTTG

ATAAATAAATTGAATTATTTGGTTTTTAAAGACATTTCAATAACTGAGAACGGGGGTCTC

TTGAAGGGGTACCAATTGACTTATATTCCGGACAAGTTGAAGAATGTCGGACACCAGTGT

GGTTGCATTTTCTACGTGCCTGCCGCTTACACCTCAAAAATCGATCCGACCACTGGTTTT

GTAAATATATTTAAATTCAAAGATCTCACCGTTGATGCCAAACGGGAGTTTATCAAAAAA

TTCGATTCCATTCGCTACGACTCTGAGAAAAACCTTTTTTGTTTCACGTTCGATTATAAC

AACTTTATAACCCAAAATACTGTAATGTCCAAGTCAAGTTGGTCTGTCTATACTTACGGA

GTAAGGATCAAGCGCCGCTTCGTTAATGGGAGATTCTCAAACGAGTCTGATACCATAGAC

ATAACTAAAGACATGGAAAAAACCCTGGAAATGACGGACATCAATTGGCGAGACGGGCAT

GATCTTCGACAGGACATAATAGATTACGAAATTGTTCAACACATTTTCGAGATATTTCGA

CTTACGGTTCAGATGAGGAATTCCCTTTCCGAATTGGAAGACCGGGATTATGATCGACTT

ATATCTCCCGTGCTCAATGAAAACAATATTTTTTATGATTCAGCGAAAGCTGGGGACGCG

CTGCCAAAAGATGCCGATGCCAATGGAGCATACTGTATCGCCCTGAAGGGTTTGTATGAG

ATTAAGCAAATTACTGAAAACTGGAAGGAAGATGGCAAGTTTTCTAGAGATAAGCTTAAG

ATTAGCAATAAGGACTGGTTTGACTTCATTCAAAATAAAAGGTATCTTAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 105

CCAGCGGCTAAAAAAAAGAAACTGGATGGCAGCGTGGATATGAATAATGGAACAAATAAT

TTTCAAAATTTTATTGGTATCAGTTCATTGCAAAAGACTTTGAGAAATGCTTTGATCCCG

ACTGAGACCACACAGCAGTTCATCGTCAAAAATGGCATAATCAAGGAAGACGAACTTAGG

GGTGAGAATAGACAAATATTGAAGGACATCATGGATGACTATTATAGGGGGTTCATTTCC

GAAACGCTCAGTAGTATTGATGACATTGACTGGACTAGTCTTTTCGAGAAAATGGAAATT

CAGCTTAAGAACGGGGACAATAAAGACACGCTGATCAAGGAGCAAACGGAATATAGGAAG

GCGATCCATAAAAAATTCGCGAATGATGATCGGTTTAAAAACATGTTTAGTGCCAAGTTG

ATCAGCGACATACTGCCCGAATTCGTGATCCACAACAATAATTACAGCGCCTCCGAAAAG

GAGGAAAAAACTCAGGTCATTAAATTGTTTAGCCGATTCGCAACGAGTTTCAAAGATTAT

TTTAAGAACCGGGCCAACTGTTTTTCAGCGGATGATATTAGCTCCAGCAGCTGCCATCGC

ATAGTAAATGATAACGCTGAAATCTTTTTTAGCAACGCACTTGTCTACCGGAGGATTGTA

AAATCACTGTCAAATGATGACATTAACAAAATATCTGGAGATATGAAGGACTCACTCAAA

GAAATGAGCCTGGAAGAAATATATTCATACGAAAAATACGGGGAGTTTATTACCCAGGAA

-continued

GGTATCAGTTTTTATAATGATATATGTGGAAAAGTTAATTCATTTATGAATCTTTACTGT

CAAAAAAATAAGGAGAACAAGAATTTGTACAAGCTCCAAAAACTTCATAAACAGATTCTG

TGCATCGCAGACACAAGTTATGAGGTACCGTACAAATTTGAGAGCGACGAAGAAGTTTAT

CAGAGTGTGAATGGTTTCCTGGACAATATCTCTTCTAAACACATTGTTGAGAGGCTTAGG

AAGATCGGTGATAATTATAACGGCTATAATCTGGACAAAATTTATATTGTATCAAAGTTT

TATGAATCAGTCTCTCAAAAGACGTATCGGGATTGGGAAACAATTAACACGGCTCTGGAG

ATCCACTACAATAACATTCTGCCCGGCAACGGGAAGAGCAAAGCTGATAAGGTCAAGAAG

GCAGTCAAGAACGACCTTCAGAAGAGCATAACAGAAATTAACGAATTGGTCAGTAACTAC

AAACTGTGTAGTGATGACAACATAAAAGCCGAAACATACATCCATGAAATAAGCCATATC

CTGAATAACTTCGAAGCCCAAGAACTTAAATACAATCCCGAGATTCATCTTGTCGAATCA

GAACTCAAGGCGTCCGAGCTCAAAAATGTCCTTGACGTGATAATGAATGCCTTCCACTGG

TGCAGCGTATTCATGACGGAGGAGTTGGTAGATAAAGACAACAACTTTTATGCCGAATTG

GAAGAGATTTATGATGAGATTTACCCCGTTATTTCTCTGTACAACTTGGTTCGAAACTAC

GTAACACAAAAACCATACTCAACCAAAAAGATCAAACTCAATTTTGGCATACCTACATTG

GCTGATGGTTGGTCCAAGTCAAAGGAATATAGCAATAATGCAATAATTCTCATGCGAGAT

AACTTGTATTATTTGGGGATCTTTAACGCTAAGAACAAACCAGATAAAAAGATAATCGAG

GGGAACACAAGTGAGAACAAGGGTGATTACAAAAAAATGATTTACAATCTGCTTCCTGGG

CCTAACAAAATGATTCCGAAGGTGTTTCTTAGCTCTAAAACTGGAGTGGAGACGTATAAG

CCTTCCGCGTACATTCTCGAAGGCTACAAGCAAAATAAGCATATCAAGTCCAGTAAGGAC

TTCGACATCACTTTTTGCCACGATCTCATCGATTACTTTAAGAACTGTATCGCAATACAC

CCCGAGTGGAAAAACTTTGGTTTTGATTTTTCAGACACTAGTACCTACGAGGACATTTCC

GGCTTCTATCGAGAAGTCGAACTCCAGGGCTACAAAATCGATTGGACGTACATTTCTGAG

AAGGACATCGACTTGCTCCAAGAGAAAGGTCAACTTTACCTCTTCCAAATTTACAATAAA

GACTTTTCAAAGAAGAGCACCGGTAATGACAACTTGCATACCATGTATCTGAAGAACCTG

TTTTCTGAGGAGAACCTCAAGGATATTGTATTGAAGTTGAATGGCGAAGCAGAAATATTT

TTCCGAAAGTCATCTATCAAGAACCCCATTATACACAAAAAAGGCTCTATCCTGGTGAAC

CGGACTTACGAGGCAGAGGAGAAGGATCAATTCGGAAACATACAGATAGTCCGCAAAAAC

ATCCCTGAGAATATCTATCAGGAACTCTATAAGTACTTCAATGATAAATCAGACAAGGAG

CTTAGCGACGAAGCAGCTAAACTTAAAAACGTGGTTGGCCATCACGAGGCCGCTACCAAC

ATAGTCAAAGACTACCGCTATACTTATGACAAGTACTTTTTGCACATGCCCATAACAATT

AATTTCAAAGCTAACAAAACAGGGTTTATAAATGACAGAATCCTCCAATACATCGCCAAA

GAGAAGGACCTCCATGTAATCGGGATTGATAGAGGCGAACGGAACTTGATTTACGTTAGT

GTCATTGATACCTGTGGTAACATTGTCGAACAAAAGTCATTCAACATAGTCAATGGATAT

GATTATCAGATAAAACTCAAGCAACAAGAAGGCGCGAGGCAGATTGCCAGGAAGGAATGG

AAAGAAATCGGGAAGATCAAGGAGATCAAGGAGGGTTACCTGTCCTTGGTGATACACGAG

ATTTCAAAAATGGTTATAAAATACAATGCCATTATCGCGATGGAGGATTTGTCTTATGGA

TTTAAGAAGGGGAGGTTCAAAGTCGAACGACAAGTCTATCAGAAGTTTGAAACAATGCTC

ATTAACAAGCTCAATTACCTTGTTTTCAAGGATATAAGCATCACTGAAAACGGCGGACTC

CTTAAGGGATATCAGCTGACTTATATCCCCGACAAGCTCAAGAACGTAGGGCACCAATGC

GGATGCATCTTTTACGTGCCTGCAGCATATACTTCAAAAATTGATCCGACTACTGGCTTT

GTTAACATTTTCAAGTTCAAGGATCTGACGGTAGACGCTAAGAGAGAATTCATAAAAAAG

TTTGACAGCATCAGGTACGATAGTGAAAAGAACCTTTTTTGTTTTACCTTTGACTACAAT

AATTTTATTACGCAAAATACAGTTATGAGCAAATCAAGTTGGAGCGTTTACACATATGGC

GTTCGGATCAAGCGCAGATTCGTCAATGGTCGCTTCTCAAATGAGAGCGATACAATCGAT

ATAACGAAGGATATGGAGAAGACGCTTGAGATGACAGATATCAACTGGCGGGACGGACAT

GACCTTAGACAAGACATAATCGATTACGAAATAGTACAGCATATCTTTGAGATTTTTAGG

CTTACAGTTCAGATGCGGAACTCTCTTTCCGAACTGGAGGACCGGGATTATGATCGGTTG

ATCTCCCCAGTACTGAACGAAAATAATATCTTTTACGATAGCGCGAAGGCTGGTGATGCA

CTCCCAAAAGACGCTGATGCGAACGGAGCTTATTGCATAGCCCTTAAAGGGCTTTACGAG

ATTAAACAAATAACAGAAAATTGGAAGGAAGATGGCAAATTTTCCCGCGACAAGTTGAAG

ATTAGTAACAAAGACTGGTTCGACTTCATTCAGAATAAACGCTACCTCAAACGTCCGGCA

GCGACCAAAAAAGCCGGCCAGGCGAAGAAAAAAAAAGCGTCAGGTAGCGGCGCAGGCAGC

CCGAAAAAGAAACGTAAAGTCGAGGATCCGAAAAAGAAACGTAAGGTTATTCCGGGCTAA

SEQ ID NO: 113

ATGGGCCATCATCATCATCATCATAGCAGCGGCGTGGATCTGGGCACCGAAAACCTGTAT

TTTCAGTCCATGAGCCGCCGCCGCAAAGCGAACCCGACCAAACTGAGCGAAAACGCGAAA

AAACTGGCGAAAGAAGTGGAAAACGCAAGCGGCAGCGGCGCGGGCAGCAAACGACCGGCG

GCGACCAAAAAAGCGGGCCAAGCGAAGAAAAAGAAAGCAAGCGGCAGCGGCGCGGGCAGC

CCGGCGGCAAAAAAAAAAAAACTGGACGGCAGCGTGGATGCAAGCGGCAGCGGCGCGGGC

AGCCCCAAAAAAAAACGCAAAGTTGAAGATGCAAGCGGCAGCGGCGCGGGCAGCCCGAAA

AAAAAACGTAAAGTGGCAAGCGGCAGCGGCGCGGGCAGCATGAACAACGGCACCAACAAC

TTTCAGAACTTTATTGGCATTAGCAGCCTGCAGAAAACCCTGCGCAACGCGCTGATTCCG

ACCGAAACCACGCAGCAGTTTATTGTGAAAAACGGCATTATTAAAGAAGATGAACTGCGC

GGCGAAAACCGTCAGATTCTGAAGGACATTATGGATGATTATTATCGCGGCTTTATTAGC

GAAACCCTGAGCAGCATTGATGATATAGACTGGACGAGCCTGTTTGAAAAAATGGAAATT

CAGCTGAAAAACGGCGATAACAAAGATACCCTGATTAAAGAACAGACCGAATATCGCAAA

GCGATTCATAAGAAGTTTGCGAACGATGATCGCTTTAAAAACATGTTTAGCGCGAAACTG

ATTAGCGATATTCTGCCGGAATTTGTGATTCATAACAACAACTATAGCGCGAGCGAAAAG

GAAGAAAAAACCCAAGTGATTAAACTGTTTAGCCGCTTTGCGACGAGCTTTAAAGATTAT

TTTAAAAATCGCGCGAACTGCTTTAGCGCGGATGATATTAGCAGCAGCAGCTGCCATCGC

ATTGTGAACGATAACGCGGAGATCTTTTTTAGCAATGCGCTGGTGTATCGCCGCATTGTG

AAAAGCCTGAGCAACGATGATATTAACAAAATTAGCGGCGATATGAAAGATAGCCTGAAA

GAAATGAGCCTGGAAGAAATATATAGCTATGAAAAATATGGGGAATTTATTACACAAGAG

GGCATTAGCTTTTATAACGATATTTGCGGCAAAGTGAACAGCTTTATGAACCTGTATTGT

CAGAAAAACAAAGAAAACAAAAACCTGTATAAACTGCAGAAACTGCATAAACAGATTCTG

TGCATTGCGGATACGAGCTATGAAGTGCCGTATAAATTTGAAAGCGATGAAGAAGTGTAT

CAGAGCGTGAACGGCTTTCTGGATAACATTAGCAGCAAACATATTGTGGAACGCCTGCGC

AAAATTGGCGATAACTATAACGGCTATAACCTGGATAAAATTTATATTGTGAGCAAATTT

TATGAAAGCGTGAGTCAGAAAACCTATCGCGATTGGGAAACCATTAACACCGCGCTGGAA

ATTCATTATAACAACATTCTGCCGGGCAACGGCAAAAGTAAAGCGGATAAAGTGAAAAAA

GCGGTGAAAAACGATCTGCAGAAAAGCATTACGGAAATTAACGAACTGGTGAGCAACTAT

-continued

AAACTGTGCAGCGATGATAACATTAAAGCGGAAACCTATATTCACGAGATCAGTCATATT

CTGAACAACTTTGAAGCGCAAGAACTGAAATATAACCCGGAAATTCATCTGGTGGAATCA

GAACTGAAGGCGAGCGAACTTAAGAATGTGCTAGATGTGATTATGAACGCGTTTCATTGG

TGCAGCGTGTTTATGACCGAAGAACTGGTGGATAAAGATAACAACTTTTATGCGGAACTG

GAAGAAATCTACGACGAAATTTATCCGGTGATTAGCCTGTATAACCTGGTGCGCAACTAT

GTGACGCAGAAACCGTATAGCACCAAAAAAATTAAACTGAACTTTGGCATTCCGACCCTG

GCGGATGGCTGGAGCAAGAGCAAAGAGTATAGCAACAACGCTATTATCCTAATGCGCGAT

AACCTGTATTATCTGGGCATTTTTAACGCGAAAAACAAACCGGATAAAAAAATTATTGAA

GGCAACACGAGCGAAAACAAAGGCGATTATAAAAAAATGATTTATAACCTGCTGCCGGGC

CCGAACAAAATGATTCCGAAAGTGTTTCTGAGCAGCAAAACCGGCGTGGAAACCTATAAA

CCGAGCGCGTATATTCTGGAAGGCTATAAACAGAACAAACATATTAAAAGCAGCAAAGAT

TTTGATATTACCTTTTGCCATGATCTGATTGACTACTTTAAGAACTGTATAGCGATTCAT

CCGGAATGGAAAAACTTTGGCTTTGATTTTAGCGATACGAGCACCTATGAAGACATTAGC

GGCTTTTATCGCGAAGTGGAACTGCAAGGCTATAAAATTGATTGGACCTATATTAGCGAA

AAAGATATTGATCTGCTGCAAGAAAAAGGTCAGCTGTATCTGTTTCAGATTTATAACAAA

GATTTTAGCAAAAAAAGCACCGGCAACGATAACCTGCATACCATGTATCTGAAAAATCTG

TTTTCTGAAGAAAACCTAAAAGATATTGTCCTGAAACTGAACGGCGAAGCCGAAATTTTT

TTTCGCAAGAGCAGCATTAAAAACCCGATTATTCACAAAAAAGGTAGCATTCTGGTGAAC

CGCACATACGAAGCTGAGGAAAAGGATCAGTTTGGCAACATTCAGATTGTGCGCAAAAAC

ATTCCGGAAAACATCTACCAAGAACTGTACAAATATTTTAACGATAAAAGCGATAAAGAA

CTGAGCGACGAGGCTGCGAAGCTGAAGAATGTCGTGGGCCATCATGAAGCGGCGACTAAC

ATTGTCAAAGATTATCGCTATACCTATGATAAATATTTTCTGCATATGCCGATTACCATT

AACTTTAAAGCGAACAAAACCGGCTTTATTAACGATCGCATTCTGCAGTATATTGCGAAG

GAAAAGGATCTGCACGTGATTGGCATTGATCGCGGCGAACGCAACCTGATTTATGTGAGC

GTGATTGATACCTGCGGCAACATTGTGGAACAGAAAAGCTTTAACATCGTGAACGGCTAT

GATTATCAGATTAAACTGAAACAGCAAGAAGGCGCGCGTCAGATTGCGCGCAAAGAATGG

AAAGAAATTGGCAAAATTAAAGAAATTAAAGAAGGCTATCTGAGCCTGGTGATTCATGAA

ATCAGCAAGATGGTGATTAAATATAATGCCATTATTGCGATGGAAGATCTGAGCTATGGC

TTTAAAAAAGGCCGCTTTAAAGTGGAACGCCAAGTGTATCAGAAATTTGAAACCATGCTG

ATTAACAAACTGAACTATCTGGTGTTTAAAGATATTAGTATTACTGAAAATGGCGGCCTG

CTGAAAGGCTATCAGCTGACCTATATTCCGGACAAGCTGAAGAATGTGGGCCATCAGTGC

GGCTGCATTTTTTATGTGCCGGCGGCGTATACGAGCAAAATTGATCCGACCACCGGCTTT

GTGAACATTTTTAAATTTAAAGATCTGACCGTGGATGCGAAACGGGAATTCATAAAAAAA

TTTGATAGCATTCGCTATGATAGCGAAAAGAATCTGTTTTGCTTCACCTTTGATTATAAC

AACTTTATAACGCAGAACACCGTGATGAGCAAAAGCAGCTGGAGCGTGTATACCTATGGC

GTGCGCATTAAACGCCGCTTTGTGAACGGCCGCTTTAGCAACGAAAGCGATACCATTGAT

ATTACCAAAGATATGGAAAAAACCCTGGAAATGACCGATATTAACTGGCGCGATGGCCAT

GATCTGCGCCAAGATATTATTGATTATGAAATTGTGCAGCATATTTTTGAAATTTTTCGC

CTGACCGTGCAGATGCGCAACAGCCTGAGCGAACTGGAAGATCGCGATTATGATCGCCTG

ATTAGCCCGGTGCTGAACGAAAACAACATTTTTTATGATAGCGCGAAAGCGGGCGATGCG

-continued

CTGCCGAAAGATGCGGATGCGAACGGCGCGTATTGCATTGCGCTGAAAGGCCTGTATGAA

ATTAAACAGATTACGGAAAACTGGAAAGAAGATGGCAAATTTAGCCGCGACAAGCTGAAA

ATTAGCAACAAAGATTGGTTTGATTTTATTCAGAACAAACGCTATCTGTA

In certain embodiments, a nucleic acid-guided nuclease, e.g., Type V, preferably Type VA CRISPR nuclease polypeptide disclosed herein includes a polypeptide having an amino acid sequence of at least 50% identity to SEQ ID NO:2. In certain embodiments, a nucleic acid-guided nuclease, e.g., Type V, preferably Type VA CRISPR nuclease polypeptide disclosed herein includes a polypeptide having an amino acid sequence of at least about 60%, 65%, 75%, 85%, 95%, 99% or about 100% identity, preferably at least 80%, more preferably at least 90%, even more preferably at least 95%, still more preferably at least 98% identical to amino acid sequence of SEQ ID NO:2. In certain embodiments, a nucleic acid-guided nuclease, e.g., Type V, preferably Type VA CRISPR nuclease polypeptide disclosed herein includes a polypeptide having an amino acid sequence of at least 50% identity to SEQ ID NO: 3. In certain embodiments, a nucleic acid-guided nuclease, e.g., Type V, preferably Type VA CRISPR nuclease polypeptide disclosed herein includes a polypeptide having an amino acid sequence of at least about 60%, 65%, 75%, 85%, 95%, 99% or about 100% identity, preferably at least 80%, more preferably at least 90%, even more preferably at least 95%, still more preferably at least 98% identical, to amino acid sequence of SEQ ID NO: 3. In certain embodiments, a nucleic acid-guided nuclease, e.g., Type V, preferably Type VA CRISPR nuclease polypeptide disclosed herein includes a polypeptide having an amino acid sequence of at least 50% identity to SEQ ID NO: 4. In certain embodiments, a nucleic acid-guided nuclease disclosed herein includes a polypeptide having an amino acid sequence of at least about 60%, 65%, 75%, 85%, 95%, 99% or about 100% identity, preferably at least 80%, more preferably at least 90%, even more preferably at least 95%, still more preferably at least 98% identical to amino acid sequences of SEQ ID NO: 4. In certain embodiments, a nucleic acid-guided nuclease, e.g., Type V, preferably Type VA CRISPR nuclease polypeptide disclosed herein includes a polypeptide having an amino acid sequence of at least 50% identity to any one of SEQ ID NOs: 109-112. In certain embodiments, a nucleic acid-guided nuclease disclosed herein includes a polypeptide having an amino acid sequence at least 60, 70, 80, 85, 90, 95, 98, 99%, or 100%, identical, preferably at least 80%, more preferably at least 90%, even more preferably at least 95%, still more preferably at least 98% identical to amino acid sequence of any one of SEQ ID NOs: 109-112. In certain embodiments, a nucleic acid-guided nuclease, e.g., Type V, preferably Type VA CRISPR nuclease polypeptide disclosed herein includes a polypeptide having an amino acid sequence of at least 50% identity to SEQ ID NO: 109. In certain embodiments, a nucleic acid-guided nuclease disclosed herein includes a polypeptide having an amino acid sequence at least 60, 70, 80, 85, 90, 95, 98, 99%, or 100%, identical, preferably at least 80%, more preferably at least 90%, even more preferably at least 95%, still more preferably at least 98% identical to SEQ ID NO: 109. In certain embodiments, a nucleic acid-guided nuclease, e.g., Type V, preferably Type VA CRISPR nuclease polypeptide disclosed herein includes a polypeptide having an amino acid sequence of at least 50% identity to SEQ ID NO: 110. In certain embodiments, a nucleic acid-guided nuclease disclosed herein includes a polypeptide having an amino acid sequence at least 60, 70, 80, 85, 90, 95, 98, 99%, or 100%, identical, preferably at least 80%, more preferably at least 90%, even more preferably at least 95%, still more preferably at least 98% identical to SEQ ID NO: 110. In certain embodiments, a nucleic acid-guided nuclease, e.g., Type V, preferably Type VA CRISPR nuclease polypeptide disclosed herein includes a polypeptide having an amino acid sequence of at least 50% identity to SEQ ID NO: 111. In certain embodiments, a nucleic acid-guided nuclease disclosed herein includes a polypeptide having an amino acid sequence at least 60, 70, 80, 85, 90, 95, 98, 99%, or 100%, identical, preferably at least 80%, more preferably at least 90%, even more preferably at least 95%, still more preferably at least 98% identical to SEQ ID NO: 111. In certain embodiments, a nucleic acid-guided nuclease, e.g., Type V, preferably Type VA CRISPR nuclease polypeptide disclosed herein includes a polypeptide having an amino acid sequence of at least 50% identity to SEQ ID NO: 112. In certain embodiments, a nucleic acid-guided nuclease disclosed herein includes a polypeptide having an amino acid sequence at least 60, 70, 80, 85, 90, 95, 98, 99%, or 100%, identical, preferably at least 80%, more preferably at least 90%, even more preferably at least 95%, still more preferably at least 98% identical to SEQ ID NO: 112.

Nuclear Localization Signals (NLSs)

In certain embodiments, a composition, e.g., nuclease, disclosed herein includes one or more nuclear localization sequences (NLSs), such as 1, 2, 3, 4, 5, 6, 7, 8, 9, 10, or more NLSs. In some embodiments, a composition, e.g., engineered nuclease comprises 1, 2, 3, 4, 5, 6, 7, 8, 9, 10, or more NLSs at or near the amino-terminus, 1, 2, 3, 4, 5, 6, 7, 8, 9, 10, or more NLSs at or near the carboxy-terminus, or a combination of these (e.g. one or more NLS at the amino-terminus and one or more NLS at the carboxy terminus). When more than one NLS is present, each may be selected independently of the others, such that a single NLS may be present in more than one copy and/or in combination with one or more other NLSs present in one or more copies. In certain embodiments the engineered nuclease comprises 4 NLSs.

Non-limiting examples of NLSs include an NLS sequence derived from: the NLS of the SV40 virus large T-antigen, having the amino acid sequence PKKKRKV (SEQ ID NO:5); the NLS from nucleoplasmin (e.g. the nucleoplasmin bipartite NLS with the sequence KRPAATKKAGQAKKKK (SEQ ID NO:6); the c-myc NLS having the amino acid sequence PAAKRVKLD SEQ ID NO:7) or RQRRNELKRSP (SEQ ID NO:8); the hRNPA1 M9 NLS having the sequence NQSSNFGPMKGGNFGGRSSGPYGGGGQYFAKPRNQGGY (SEQ ID NO: 9); the sequence RMRIZFKNKGKDTAELRRRRVEVSVELRKAKKDEQILKRRNV (SEQ ID NO:10) of the IBB domain from importin-alpha; the sequences VSRKRPRP (SEQ ID NO: 11) and PPKKARED (SEQ ID NO:12) of the myoma T protein; the sequence PQPKKKPL (SEQ ID NO:13) of human p53; the sequence SALIKKKKKMAP (SEQ ID NO:14) of mouse c-abl IV; the sequences DRLRR (SEQ ID NO:15) and PKQKKRK (SEQ ID NO:16) of the influenza virus NS1; the sequence RKLKKKIKKL (SEQ ID NO:17) of the Hepatitis virus delta antigen; the sequence REKKKFLKRR (SEQ ID NO:18) of the mouse Mx1 protein; the sequence KRKGDEVDGVDEVAKKKSKK (SEQ ID NO:19) of the human poly(ADP-ribose) polymerase; the sequence RKCLQAGMNLEARKTKK (SEQ ID NO:20) of the steroid hormone receptors (human) glucocorticoid; and EGL-13, MSRRRKANPTKLSENAKKLAKEVEN, SEQ ID NO: 107.

In certain embodiments, a nuclease provided herein comprises at least one myc-related NLS comprising the sequence PAAKKKKLD (SEQ ID NO:21); in certain embodiments the myc-related NLS is at the N-terminus of the nuclease. In certain embodiments, a nuclease provided herein comprises at least one nucleoplasmin NLS comprising the sequence KRPAATKKAGQAKKKK (SEQ ID NO:6); in certain embodiments the nucleoplasmin NLS is at the C-terminus of the nuclease. In certain embodiments a nuclease provided herein comprises at least one, or at least two, SV40 NLS sequences comprising the sequence PKKKRKV (SEQ ID NO: 5); in certain embodiments the SV40 NLSs are at the C-terminus of the nuclease. In certain embodiments, a nuclease provided herein comprises 1 NLS at the N-terminus and 3 NLSs at the C-terminus, for example 1 myc-related NLS at the N-terminus and one nucleoplasmin NLS and two SV40 NLSs at the C-terminus. In certain embodiments, a nuclease provided herein comprises 1 myc-related NLS at the N-terminus with the sequence PAAKKKKLD (SEQ ID NO: 21 and one nucleoplasmin NLS comprising the sequence KRPAATKKAGQAKKKK (SEQ ID NO: 6) and two SV40 NLSs comprising the sequence PKKKRKV (SEQ ID NO:5) at the C-terminus.

In general, the one or more NLSs are of sufficient strength to drive accumulation of the nucleic acid-guided nuclease in a detectable amount in the nucleus of a eukaryotic cell. In general, strength of nuclear localization activity may derive from the number of NLSs, the particular NLS(s) used, or a combination of these factors. Detection of accumulation in the nucleus may be performed by any suitable technique. For example, a detectable marker may be fused to the nucleic acid-guided nuclease, such that location within a cell may be visualized, such as in combination with a means for detecting the location of the nucleus (e.g. a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of the nucleic acid-guided nuclease complex formation (e.g. assay for DNA cleavage or mutation at the target sequence, or assay for altered gene expression activity affected by targetable nuclease complex formation and/or nucleic acid-guided nuclease activity), as compared to a control not exposed to the nucleic acid-guided nuclease or targetable nuclease complex, or exposed to a nucleic acid-guided nuclease lacking the one or more NLSs.

In certain embodiments, a nucleic acid-guided nuclease disclosed herein includes a polypeptide having an amino acid sequence of at least about 60%, 65%, 75%, 85%, 95%, 99% or about 100% identity to amino acid sequences of SEQ ID NO: 4 and at least one myc-related NLS comprising the sequence PAAKKKKLD (SEQ ID NO:21); in certain embodiments the myc-related NLS is at the N-terminus of the nuclease. In certain embodiments, a nucleic acid-guided nuclease disclosed herein includes a polypeptide having an amino acid sequence of at least about 60%, 65%, 75%, 85%, 95%, 99% or about 100% identity to amino acid sequences of SEQ ID NO: 4 and at least one nucleoplasmin NLS comprising the sequence KRPAATKKAGQAKKKK (SEQ ID NO:6); in certain embodiments the nucleoplasmin NLS is at the C-terminus of the nuclease. In certain embodiments, a nucleic acid-guided nuclease disclosed herein includes a polypeptide having an amino acid sequence of at least about 60%, 65%, 75%, 85%, 95%, 99% or about 100% identity to amino acid sequences of SEQ ID NO: 4 and at least one, or at least two, SV40 NLS sequences comprising the sequence PKKKRKV (SEQ ID NO: 5); in certain embodiments the SV40 NLSs are at the C-terminus of the nuclease. In certain embodiments, a nucleic acid-guided nuclease disclosed herein includes a polypeptide having an amino acid sequence of at least about 60%, 65%, 75%, 85%, 95%, 99% or about 100% identity to amino acid sequences of SEQ ID NO: 4 and one NLS at the N-terminus and three NLSs at the C-terminus, for example 1 myc-related NLS at the N-terminus and one nucleoplasmin NLS and two SV40 NLSs at the C-terminus. In certain embodiments, a nucleic acid-guided nuclease disclosed herein includes a polypeptide having an amino acid sequence of at least about 60%, 65%, 75%, 85%, 95%, 99% or about 100% identity to amino acid sequences of SEQ ID NO: 4, and one myc-related NLS at the N-terminus with the sequence PAAKKKKLD (SEQ ID NO:21) and one nucleoplasmin NLS comprising the sequence KRPAATKKAGQAKKKK (SEQ ID NO:6) and two SV40 NLSs comprising the sequence PKKKRKV (SEQ ID NO:5) at the C-terminus. In certain embodiments, a nucleic acid-guided nuclease disclosed herein includes a polypeptide having an amino acid sequence of at least about 60%, 65%, 75%, 85%, 95%, 99% or about 100% identity to amino acid sequences of SEQ ID NO: 1, and one, two, or three NLS at the N-terminus and one, two, or three NLS at the C-terminus. In certain embodiments, a nucleic acid-guided nuclease disclosed herein includes a polypeptide having an amino acid sequence of at least about 60%, 65%, 75%, 85%, 95%, 99% or about 100% identity to amino acid sequences of SEQ ID NO: 1, and one myc-related NLS at the N-terminus with the sequence PAAKKKKLD (SEQ ID NO:21) and one nucleoplasmin NLS comprising the sequence KRPAATKKAGQAKKKK (SEQ ID NO:6) and two SV40 NLSs comprising the sequence PKKKRKV (SEQ ID NO:5) at the C-terminus.

Purification Tags

In certain embodiments, a nucleic acid-guided nuclease provided herein can comprise a tag, e.g., a purification tag, e.g. at the N-terminus. Exemplary tags include a poly-his tag, such as a Gly-6×His tag (SEQ ID NO: 421) or Gly-8×His tag (SEQ ID NO: 422), short epitope tags such as FLAG, hemagglutinin (HA), c-myc, T7, and Glu-Glu; maltose binding protein (mbp); N-terminal glutathione S-transferase (GST); calmodulin binding peptide (CBP). In certain embodiments, a nucleic acid-guided nuclease provided herein can comprise a poly-his tag, such as a Gly-6×His tag (SEQ ID NO: 421), e.g., at the N-terminus. These Gly-6×His tags (SEQ ID NO: 421) are applied for several reasons including: 1) a 6×His tag (SEQ ID NO: 423) can be used in protein purification to allow binding to the chromatographic columns for purification, and 2) the N-terminal glycine allows further, site-specific, chemical modifications that permit advanced protein engineering. Further, the Gly-6×His (SEQ ID NO: 421) is designed for easy removal, if desired, by digestion with Tobacco Etch Virus (TEV) protease. For these constructs, the Gly-6×His tag (SEQ ID NO: 421) was positioned on the N-terminus. Gly-6×His tags (SEQ ID NO: 421) are further described in Martos-Maldonado et al., *Nat Commun*. (2018) 17; 9 (1): 3307, the disclosure of which is incorporated herein. Thus, in certain embodiments provided herein is a nucleic acid-guided nuclease disclosed herein includes a polypeptide having an amino acid sequence of at least about 60%, 65%, 75%, 85%, 95%, 99% or about 100% identity to amino acid sequences of SEQ ID NO: 4 and a poly-His tag at the N-terminus, such as a Gly-6×His tag (SEQ ID NO: 421). In certain embodiments provided herein is a nucleic acid-guided nuclease disclosed herein includes a polypeptide having an amino acid sequence of at least about 60%, 65%, 75%, 85%, 95%, 99% or about 100% identity to amino acid sequences of SEQ ID NO: 4, a poly-His tag at the N-terminus, such as a Gly-6×His tag (SEQ ID NO: 421), and/or a TEV cleavage site at the N-terminus. In certain embodiments provided herein is a nucleic acid-guided nuclease having a poly-His tag at the N-terminus, such as a Gly-6×His tag (SEQ ID NO: 421) and a TEV cleavage site at the N-terminus, such as a polypeptide having at least about 60%, 65%, 75%, 85%, 95%, 99% or about 100% identity to amino acid sequences of SEQ ID NO: 2. In certain embodiments provided herein is a nucleic acid-guided nuclease disclosed herein includes a polypeptide having an amino acid sequence of at least about 60%, 65%, 75%, 85%, 95%, 99% or about 100% identity to amino acid sequences of SEQ ID NO: 1, a poly-His tag at the N-terminus, such as a Gly-6×His tag (SEQ ID NO: 421), and/or a TEV cleavage site at the N-terminus. Additionally or alternatively, the nuclease may comprise one or more NLS as described herein.

Cleavage Sites

In addition to, or alternatively to, including one or more NLSs, purification tags, and/or other additional amino acid sequences described herein, an engineered nuclease polypeptide disclosed herein can include one or more cleavage sites, which can be at or near the N-terminus or the C-terminus. Any suitable cleavage site can be used; if a plurality of cleavage sits is used, they may be the same or different. In certain embodiments a cleavage site comprises a Tobacco Etch Virus protease cleavage sequence, herein referred to as a "TEV sequence" (SEQ ID NO: 108). The TEV sequence can be at or near the amino terminus. Generally, the cleavage sequence, e.g., TEV sequence, is located so that cleavage at the cleavage sequence leaves other additional amino acid sequences, in particular any NLS added to the original nuclease polypeptide, intact. A TEV cleavage site can have the amino acid sequence ENLYFQS (SEQ ID. NO: 108.

In certain embodiments, provided herein is a nucleic acid sequence encoding a polypeptide having at least 50% nucleic acid identity to a polypeptide represented by SEQ ID NO: 2. In certain embodiments, provided herein is a nucleic acid sequence encoding a polypeptide having at least about 60%, 65%, 70%, 75%, 80%, 85%, 90%, 95%, greater than 95%, or 100% to a polypeptide represented by SEQ ID NO: 2. In certain embodiments, provided herein is a nucleic acid sequence encoding a polypeptide having at least at least 50% nucleic acid identity to a polypeptide represented by SEQ ID NO: 3. In certain embodiments, provided herein is a nucleic acid sequence encoding a polypeptide having at least about 60%, 65%, 70%, 75%, 80%, 85%, 90%, 95%, greater than 95%, or 100% to a polypeptide represented by SEQ ID NO: 3. In certain embodiments, provided herein is a nucleic acid sequence encoding a polypeptide having at least at least 50% nucleic acid identity to a polypeptide represented by SEQ ID NO: 4. In certain embodiments, provided herein is a nucleic acid sequence encoding a polypeptide having at least about 60%, 65%, 70%, 75%, 80%, 85%, 90%, 95%, greater than 95%, or 100% to a polypeptide represented by SEQ ID NO: 4. In certain embodiments, provided herein is a nucleic acid of at least about 50%, 60%, 65%, 70%, 75%, 80%, 85%, 90%, 95%, 99%, or 100% polynucleotide identity to any one of SEQ ID NOS: 23-105. In certain embodiments, provided herein is a nucleic acid of at least about 50%, 60%, 65%, 70%, 75%, 80%, 85%, 90%, 95%, 99%, or 100% polynucleotide identity to any one of SEQ ID NOS: 23-42 In certain embodiments, provided herein is a nucleic acid of at least about 50%, 60%, 65%, 70%, 75%, 80%, 85%, 90%, 95%, 99%, or 100% polynucleotide identity to any one of SEQ ID NOS: 43-65. In certain embodiments, provided herein is a nucleic acid of at least about 50%, 60%, 65%, 70%, 75%, 80%, 85%, 90%, 95%, 99%, or 100% polynucleotide identity to any one of SEQ ID NOS: 43-53. In certain embodiments, provided herein is a nucleic acid of at least about 50%, 60%, 65%, 70%, 75%, 80%, 85%, 90%, 95%, 99%, or 100% polynucleotide identity to any one of SEQ ID NOS: 54-58. In certain embodiments, provided herein is a nucleic acid of at least about 50%, 60%, 65%, 70%, 75%, 80%, 85%, 90%, 95%, 99%, or 100% polynucleotide identity to any one of SEQ ID NOS: 59-63. In certain embodiments, provided herein is a nucleic acid of at least about 50%, 60%, 65%, 70%, 75%, 80%, 85%, 90%, 95%, 99%, or 100% polynucleotide identity to any one of SEQ ID NO: 43. In certain embodiments, provided herein is a nucleic acid of at least about 50%, 60%, 65%, 70%, 75%, 80%, 85%, 90%, 95%, 99%, or 100% polynucleotide identity to any one of SEQ ID NOS: 64-84. In certain embodiments, provided herein is a nucleic acid of at least about 50%, 60%, 65%, 70%, 75%, 80%, 85%, 90%, 95%, 99%, or 100% polynucleotide identity to any one of SEQ ID NO: 64. In certain embodiments, provided herein is a nucleic acid of at least about 50%, 60%, 65%, 70%, 75%, 80%, 85%, 90%, 95%, 99%, or 100% polynucleotide identity to any one of SEQ ID NOS: 64-74. In certain embodiments, provided herein is a nucleic acid of at least about 50%, 60%, 65%, 70%, 75%, 80%, 85%, 90%, 95%, 99%, or 100% polynucleotide identity to any one of SEQ ID NOS: 75-79. In certain embodiments, provided herein is a nucleic acid of at least about 50%, 60%, 65%, 70%, 75%, 80%, 85%, 90%, 95%, 99%, or 100% polynucleotide identity to any one of SEQ ID NOS: 80-84. In certain embodiments, provided herein is a nucleic acid of at least about 50%, 60%, 65%, 70%, 75%, 80%, 85%, 90%, 95%, 99%, or 100% polynucleotide identity to any one of SEQ ID NOS: 85-105. In certain embodiments, provided herein is a nucleic acid of at least about 50%, 60%, 65%, 70%, 75%, 80%, 85%, 90%, 95%, 99%, or 100% polynucleotide identity to any one of SEQ ID NO: 85. In certain embodiments, provided herein is a nucleic acid of at least about 50%, 60%, 65%, 70%, 75%, 80%, 85%, 90%, 95%, 99%, or 100% polynucleotide identity to any one of SEQ ID NOS: 85-95. In certain embodiments, provided herein is a nucleic acid of at least about 50%, 60%, 65%, 70%, 75%, 80%, 85%, 90%, 95%, 99%, or 100% polynucleotide identity to any one of SEQ ID NOS: 96-100. In certain embodiments, provided herein is a nucleic acid of at least about 50%, 60%, 65%, 70%, 75%, 80%, 85%, 90%, 95%, 99%, or 100% polynucleotide identity to any one of SEQ ID NOS: 101-105.

A nucleic acid sequence encoding a nucleic acid-guided nuclease can be operably linked to a promoter. Such nucleic acid sequences can be linear or circular. The nucleic acid sequences can be encompassed on a larger linear or circular nucleic acid sequences that comprises additional elements such as an origin of replication, selectable or screenable marker, terminator, other components of a targetable nuclease system, such as a guide nucleic acid, and/or an editing or recorder cassette as disclosed herein. In some aspects, nucleic acid sequences can include sequences that code for at least one glycine, at least one poly-histidine tag, such as a 6× histidine tag (SEQ ID NO: 423), and/or at least one, two, three, four, or five nuclear localization signal tags, some or all of which can be on the amino side of the polypeptide, the carboxy side of the polypeptide, or a combination thereof. Larger nucleic acid sequences can be recombinant expression vectors, as are described in more detail later.

Guide Nucleic Acids

In certain embodiments, compositions and methods disclosed herein include a guide nucleic acid (gNA), e.g., a gRNA.

In general, a guide polynucleotide, also referred to as a guide nucleic acid (gNA) can complex with a compatible nucleic acid-guided nuclease, such as those disclosed herein, and can hybridize with a target nucleic acid sequence, thereby directing the nuclease to the target nucleic acid sequence. A subject nucleic acid-guided nuclease capable of complexing with a guide polynucleotide can be referred to as a nucleic acid-guided nuclease that is compatible with the guide polynucleotide. In addition, a guide polynucleotide capable of complexing with a nucleic acid-guided nuclease can be referred to as a guide polynucleotide or a guide nucleic acid that is compatible with the nucleic acid-guided nuclease. In some embodiments, a polynucleotide (gRNA) disclosed herein can be split into fragments, e.g., two separate polynucleotides, in some cases encompassing a synthetic tracrRNA and crRNA. Such gNAs, e.g., gRNAs, can be referred to as dual or split gNA, e.g., gRNA.

A guide polynucleotide can be DNA. A guide polynucleotide can be RNA. A guide polynucleotide can include both DNA and RNA. A guide polynucleotide can include modified or non-naturally occurring nucleotides. In cases where the guide polynucleotide comprises RNA, the RNA guide polynucleotide can be encoded by a DNA sequence on a polynucleotide molecule such as a plasmid, linear construct, or editing cassette as disclosed herein.

A guide polynucleotide can comprise a guide sequence, also referred to herein as a spacer sequence. A guide (spacer) sequence is a polynucleotide sequence having sufficient complementarity with a target polynucleotide sequence, also referred to herein as a target nucleic acid sequence, to hybridize with the target sequence and direct sequence-specific binding of a complexed nucleic acid-guided nuclease to the target sequence. The degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences. In some embodiments, a guide sequence can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In other embodiments, a guide sequence can be less than about 75, 50, 45, 40, 35, 30, 25, 20 nucleotides in length. Preferably the guide sequence is 10-30 nucleotides long. The guide sequence can be 15-20 nucleotides in length. The guide sequence can be 15 nucleotides in length. The guide sequence can be 16 nucleotides in length. The guide sequence can be 17 nucleotides in length. The guide sequence can be 18 nucleotides in length. The guide sequence can be 19 nucleotides in length. The guide sequence can be 20 nucleotides in length.

A guide polynucleotide can include a scaffold sequence. In general, a "scaffold sequence" can include any sequence that has sufficient sequence to promote formation of a targetable nuclease complex, wherein the targetable nuclease complex includes, but is not limited to, a nucleic acid-guided nuclease and a guide polynucleotide that can include a scaffold sequence and a guide sequence. Sufficient sequence within the scaffold sequence to promote formation of a targetable nuclease complex may include a degree of complementarity along the length of two sequence regions within the scaffold sequence, such as one or two sequence regions involved in forming a secondary structure. In some cases, the one or two sequence regions are included or encoded on the same polynucleotide. In some cases, the one or two sequence regions are included or encoded on separate polynucleotides. Optimal alignment may be determined by any suitable alignment algorithm, and may further account for secondary structures, such as self-complementarity within either the one or two sequence regions. In some embodiments, the degree of complementarity between the one or two sequence regions along the length of the shorter of the two when optimally aligned is about or more than about 25%, 30%, 40%, 50%, 60%, 70%, 80%, 90%, 95%, 97.5%, 99%, or higher. In some embodiments, at least one of the two sequence regions can be about or more than about 5, 6, 7, 8, 9, 10, 11, 12, 13, 14, 15, 16, 17, 18, 19, 20, 25, 30, 40, 50, or more nucleotides in length.

A scaffold sequence of a subject guide polynucleotide can comprise a secondary structure. A secondary structure can comprise a pseudoknot region. In some cases, binding kinetics of a guide polynucleotide to a nucleic acid-guided nuclease is determined in part by secondary structures within the scaffold sequence. In some cases, binding kinetics of a guide polynucleotide to a nucleic acid-guided nuclease is determined in part by nucleic acid sequence with the scaffold sequence. In some aspects, the invention provides a nuclease that binds to a guide polynucleotide can include a conserved scaffold sequence. For example, the nucleic acid-guided nucleases for use in the present disclosure can bind to a conserved pseudoknot region.

In certain embodiments, the engineered polynucleotide (gRNA) can be split into fragments encompassing a synthetic tracrRNA and crRNA.

As used herein, "guide nucleic acid" or "guide polynucleotide" can refer to one or more polynucleotides and can include 1) a guide (spacer) sequence capable of hybridizing to a target sequence and 2) a scaffold sequence capable of interacting with or complexing with a nucleic acid-guided nuclease as described herein. A guide nucleic acid can be provided as one or more nucleic acids. In specific embodiments, the guide sequence and the scaffold sequence are provided as a single polynucleotide. In other aspects, guide nucleic acid may include at least one amplicon targeting fragments.

A guide nucleic acid can be compatible with a nucleic acid-guided nuclease when the two elements can form a functional targetable nuclease complex capable of cleaving a target sequence. In certain methods, a compatible scaffold sequence for a compatible guide nucleic acid can be found by scanning sequences adjacent to a native nucleic acid-guided nuclease loci. For example, native nucleic acid-guided nucleases can be encoded on a genome within proximity to a corresponding compatible guide nucleic acid or scaffold sequence.

Nucleic acid-guided nucleases can be compatible with guide nucleic acids that are not found within the nucleases endogenous host. Such orthogonal guide nucleic acids can be determined by empirical testing. Orthogonal guide nucleic acids can come from different bacterial species or be synthetic or otherwise engineered to be non-naturally occurring.

Orthogonal guide nucleic acids that are compatible with a common nucleic acid-guided nuclease can comprise one or more common features. Common features can include sequence outside a pseudoknot region. Common features can include a pseudoknot region. Common features can include a primary sequence or secondary structure.

A guide nucleic acid can be engineered to target a desired target sequence by altering the guide (spacer) sequence such that the guide sequence is complementary to the target sequence, thereby allowing hybridization between the guide sequence and the target sequence. A guide nucleic acid with an engineered guide sequence can be referred to as an engineered guide nucleic acid. Engineered guide nucleic acids are often non-naturally occurring and are not found in nature.

Engineered guide nucleic acids can be formed using a Synthetic Tracr RNA (STAR) system. STAR, when combined with a Cas12a protein, can form at least one ribonucleoprotein (RNP) complex that targets a specific genomic locus. STAR takes advantage of the natural properties of the CRISPR (Clustered Regularly Interspaced Short Palindromic Repeats) where the CRISPR system functions much like an immune system against invading viruses and plasmid DNA. Short DNA sequences (spacers) from invading viruses are incorporated at CRISPR loci within the bacterial genome and serve as "memory" of previous infections. Reinfection triggers complementary mature CRISPR RNA (crRNA) to find a matching viral sequence. Together, the crRNA and trans-activating crRNA (tracrRNA) guide CRISPR-associated (Cas) nuclease to cleave double-strand breaks in "foreign" DNA sequences. The prokaryotic CRISPR "immune system" has been engineered to function as an RNA-guided, mammalian genome editing tool that is simple, easy and quick to implement. STAR (which includes synthetic crRNA and tracrRNA) when combined with Cas12a protein can form ribonucleoprotein (RNP) complexes that target a specific genomic locus. Engineered guide nucleic acids formed with the RNA (STAR) system can result in a split gRNA. Split gRNA, i.e., dual guide RNAs are described more fully in WO 2021067788A1.

In certain embodiments, provided herein are ribonucleoprotein (RNP) complexes that include at least one nuclease disclosed herein. In certain embodiments, a RNP complex can include at least one nuclease having an amino acid sequence of at least 50% identity to SEQ ID NO: 2. In certain embodiments, a RNP complex can include at least one nuclease having an amino acid sequence of at least about 60%, 65%, 75%, 85%, 95%, 99% or about 100% identity to amino acid sequences of SEQ ID NO:2. In certain embodiments, a RNP complex can include at least one nuclease having an amino acid sequence of at least 50% identity to SEQ ID NO:3. In certain embodiments, a RNP complex can include at least one nuclease having an amino acid sequence of at least about 60%, 65%, 75%, 85%, 95%, 99% or about 100% identity to amino acid sequences of SEQ ID NO:3. In certain embodiments, a RNP complex can include at least one nuclease having an amino acid sequence of at least 50% identity to SEQ ID NO:4. In certain embodiments, a RNP complex can include at least one nuclease having an amino acid sequence of at least about 60%, 65%, 75%, 85%, 95%, 99% or about 100% identity to amino acid sequences of SEQ ID NO:4. In certain embodiments, a RNP complex including a nuclease disclosed herein can further include at least one STAR gRNA (dual guide RNA). In certain embodiments, a RNP complex including a nuclease disclosed herein can further include at least one non-STAR gRNA (e.g., single guide RNA). In certain embodiments, a RNP complex including a nuclease disclosed herein can further include at least one polynucleotide. In certain embodiments, a polynucleotide included in a RNP complex disclosed herein can be greater than about 50 nucleotides in length. In certain embodiments, a polynucleotide included in a RNP complex disclosed herein can be about 50, to about 150, to about 500, to about 1000 nucleotides, or greater than 1000 nucleotides in length. In certain embodiments, more than one nuclease can be added to an RNP complex to affect the overall editing efficiency. In certain embodiments, more than one gRNA can be added to the RNP complex to allow for multiplexed editing of more than one site in a single transfection for improved efficiency. In other embodiments, more than one DNA template can be added to the RNP to allow for multiplexed editing at one or more sites based on a specific desired repair outcome.

In certain embodiments, a composition comprising a Type V, e.g., Type VA, CRISPR nuclease polypeptide, such as described herein, further comprises a guide nucleic acid (gNA), e.g., gRNA, comprising a spacer sequence that targets a target nucleotide sequence (also referred to herein as a target nucleic acid sequence) within a polynucleotide (also referred to herein as a target polynucleotide, as will be clear from context), or a polynucleotide coding for the gNA, e.g., gRNA, wherein the gNA, e.g., gRNA is compatible with the Type V, e.g., Type VA, CRISPR nuclease. In general, a polynucleotide within which a target target nucleotide sequence (target nucleic acid sequence) is located, as that term is used herein, includes a polynucleotide that includes the target target nucleotide sequence (target nucleic acid sequence). Such a polynucleotide can be any suitable polynucleotide, such as a genome of a cell or part of a genome of a cell. In certain embodiments, the target nucleotide sequence (target nucleic acid sequence) is within 50 nucleotides of a protospacer adjacent motif (PAM) sequence specific for the Type V CRISPR nuclease, such as a PAM comprising a sequence of YTTN, wherein Y is T or C and Nis A, T, G, or C, or a sequence of YTTV or TTTV, wherein Vis A, G, or C. In certain embodiments the PAM comprises a sequence of YTTV or TTTV, wherein Vis A, G, or C. In certain embodiments, the gNA is a gRNA, such as a dual (split) gRNA. The gNA, e.g. gRNA, can comprise one or more chemical modifications, such as 2'-O-alkyl, a 2'-O-methyl, a phosphorothioate, a phosphonoacetate, a thiophosphonoacetate, a 2'-O-methyl-3'-phosphorothioate, a 2'-O-methyl-3'-phosphonoacetate, a 2'-O-methyl-3'-thiophosphonoacetate, a 2'-deoxy-3'-phosphonoacetate, a 2'-deoxy-3'-thiophosphonoacetate, a suitable alternative, or a combination thereof. In certain embodiments, a ratio of guanine:uracil in the gRNA is at least 51:49, 52:48, 53:47, 54:46, 55:45, 56:44, 57:43, 58:42, 59:42, or 60:40, preferably at least 53:47, more preferably at least 54:46, even more preferably at least 55:45. See Example 12 and FIG. 10. In certain embodiments, a molar ratio of gNA, e.g., gRNA to Type V CRISPR nuclease is at least 1.1:1, 1.2:1, 1.3:1, 1.4:1, 1.5:1, 1.6:1, 1.7:1, 1.8:1, 2:1, 2.2:1, 2.5:1, or 3:1 and/or not more than 1.2:1, 1.3:1, 1.4:1, 1.5:1, 1.6:1, 1.7:1, 1.8:1, 2:1, 2.2:1, 2.5:1, 3:1, or 4:1, preferably 1.1:1 to 2.5:1, more preferably 1.2:1 to 2:1, even more preferably 1.2:1 to 1.7:1. See, e.g., Example 13. In certain embodiments a molar amount of gNA, e.g., gRNA, is at least 10, 25, 30, 35, 40, 45, 50, 55, 60, 65, 70, 75, 80, 85, 90, 95, 100, 110, 120, 130, 140, 150, 170, 190 or 200 pmol and/or not more than 30, 35, 40, 45, 50, 55, 60, 65, 70, 75, 80, 85, 90, 95, 100, 110, 120, 130, 140, 150, 170, 190, 200, 250, or 300 pmol, preferably 25-200 pmol, more preferably 50-100 pmol, even more preferably 65 to 85 pmol. See Example 13.

In certain embodiments, a composition comprising a Type V, e.g., Type VA, CRISPR nuclease polypeptide, such as described herein, further includes a donor template, also referred to as an editing template herein. A donor template can comprise homology arms, that is, nucleotide sequences that are complementary with polynucleotide sequences on either side of a cleavage site at which the donor template will be inserted. The donor template can be present in any suitable amount, e.g., in certain embodiments, at least 0.1, 0.2, 0.3, 0.4, 0.5, 0.6, 0.7, 0.8, 0.9, 1, 1.1, 1.2, 1.3, 1.4, 1.5, 1.7, 2, 2.5, 3, 4, or 5 μg $\mu L^{-1}$ and/or not more than 0.2, 0.3, 0.4, 0.5, 0.6, 0.7, 0.8, 0.9, 1, 1.1, 1.2, 1.3, 1.4, 1.5, 1.7, 2, 2.5, 3, 4, 5, 7, or 10 μg $\mu L^{-1}$, preferably 0.3 to 2 μg $\mu L^{-1}$, more preferably 0.5 to 1.5 μg $\mu L^{-1}$, even more preferably 0.8 to 1.2 μg $\mu L^{-1}$.

In certain embodiments, a composition comprising a Type V, e.g., Type VA, CRISPR nuclease polypeptide, such as described herein, further includes an anionic polymer. Any suitable anionic polymer may be used. Exemplary anionic polymers include 1,2,3-heptanetriol, 2-Amino-2-(hydroxymethyl)-1,3-propanediol (Tris), 3-(1-pyridino)-1-propane sulfonate (NDSB 201), 3-[(3-cholamidopropyl)dimethylammonio]-1-propanesulfonate (CHAPS), 6-aminocaproic acid, adenosine diphosphate (ADP), adenosine triphosphate (ATP), alpha-cyclodextrin, amidosulfobetaine-14 (ASB-14), ammonium acetate, ammonium nitrate, ammonium sulfate, arginine, arginine ethylester, barium chloride, barium iodide, benzamidine HCl, beta-cyclodextrin, beta-mercaptoethanol (BME), biotin, calcium chloride, cesium chloride, cesium sulfate, cetyltrimethylammonium bromide (CTAB), choline chloride, citric acid, cobalt chloride, copper (II) chloride, cyclohexanol, D-sorbitol, dimethylethylammoniumpropane sulfonate (NDSB 195), dithiothreitol (DTT), erythritol, ethanol, ethylene glycol, ethylene glycol-bis(βbeta-aminoethyl ether)-N,N,N',N'-tetraacetic acid (EGTA), ethylenediaminetetraacetic acid (EDTA), formamide, gadolinium bromide, gamma butyrolactone, glucose, glutamic acid, glutamine, glycerol, glycine, glycine betaine, glycine-glycine-glycine, guanidine HCl, guanosine triphosphate (GTP), holmium chloride, imidazole, iron (III) chloride, Jeffamine M-600, lanthanum acetate, lauryl sulfobetaine, lauryldimethylamine N-oxide (LDAO), lithium sulfate, magnesium chloride, magnesium sulfate, manganese chloride, mannitol, N-(2-hydroxyethyl) piperazine-N'-(3-propanesulfonic acid) (EPPS), N-dodecyl beta-D-maltoside (DDM), N-ethylurea, n-hexanol, N-lauryl sarcoside, N-lauryl sarcosine, N-methylformamide, N-methylurea, n-octyl-b-D-glucoside (OG: Octyl glucoside), n-penthanol, nickel chloride, non-detergent sulfo betaine (NDSB), Nonidet P40 (NP40), octyl beta-D-glucopyranoside, poly-L-glutamic acid, polyethylene glycol (for example, PEG 300, PEG 3350, PEG 4000), polyethyleneglycol lauryl ether (Brij 35), polyoxyethylene (2) oleyl ether (Brij 93), polyoxyethylene cetyl ether (Brij 56), polyvinylpyrrolidone 40 (PVP40), potassium chloride, potassium citrate, potassium nitrate, proline, putrescine, spermidine, spermine, riboflavin, samarium bromide, sarcosine, sodium acetate, sodium chloride, sodium dodecyl sulfate (SDS), sodium fluoride, sodium iodide, sodium lauroyl sarcosinate (Sarkosyl), sodium malonate, sodium molybdate, sodium selenite, sodium sulfate, sodium thiocyanate, sucrose, taurine, trehalose, tricine, triethylamine, trimethylamine N-oxide (TMAO), tris(2-carboxyethyl) phosphine (TCEP), Triton X-100, Tween 20, Tween 60, Tween 80, urea, vitamin B12, xylitol, yttrium chloride, yttrium nitrate, zinc chloride, Zwittergent 3-08, Zwittergent 3-14, or a combination thereof. In certain embodiments, an anionic polymer comprises polyglutamic acid. In certain embodiments, the anionic polymer, e.g., PGA, is present at a concentration of at least 20, 50, 60, 70, 80, 90, 100, 110, 120, 130, 140, 150, 170, 200, 250, 300, 400, or 500 μg $\mu L^{-1}$ and/or not more than 50, 60, 70, 80, 90, 100, 110, 120, 130, 140, 150, 170, 200, 250, 300, 400, 500, 700, or 1000 μg $\mu L^{-1}$, preferably 20 to 200 μg $\mu L^{-1}$, more preferably 50 to 150 μg $\mu L^{-1}$, even more preferably 80 to 120 μg $\mu L^{-1}$. (PGA).

In certain embodiments, provided herein is a cell containing one or more of the compositions described herein, e.g. a composition comprising a Type V, e.g., Type VA, CRISPR nuclease polypeptide comprising one or more NLSs and, in certain embodiments a purification tag and/or cleavage site. Any suitable cell may be used. In certain embodiments the cell is a human cell, such as an immune cell, e.g., T cell, or a stem cell, e.g., induced pluripotent stem cell (iPSC).

In certain embodiments, provided herein are methods of inserting one or more of the compositions described herein, e.g., a composition comprising a Type V, e.g., Type VA, CRISPR nuclease polypeptide comprising one or more NLSs and, in certain embodiments a purification tag and/or cleavage site, into a cell. Any suitable method for insertion may be used. In certain embodiments, electroporation is used. Electroporation conditions can be optimized, see, e.g., Examples.

In certain embodiments provided are methods of modifying a target polynucleotide comprising contacting the target polynucleotide with a composition or compositions as described herein, e.g, a composition comprising a Type V, e.g., Type VA, CRISPR nuclease polypeptide comprising one or more NLSs and a suitable gNA, e.g., gRNA, and allowing the composition to modify the target polynucleotide, in some cases a genomic region, such as a genome or part of a genome within a cell, e.g. human cell such as an immune cell, e.g., T cell, or a stem cell, e.g., iPSC. In certain cases, the composition or compositions comprises a donor template, such as a donor template comprising a polynucleotide coding for a polypeptide to be expressed by the cell, in certain embodiments the polypeptide comprises a chimeric antigen receptor (CAR) or portion thereof; see, e.g., Examples. In certain embodiments the cell is a human cell, e.g., immune cell such as a T cell, or stem cell, such as an iPSC.

Nuclease Systems

In certain embodiments disclosed herein are targetable nuclease systems. In certain embodiments, targetable nuclease system can include a nucleic acid-guided nuclease and a compatible guide nucleic acid (also referred to interchangeably herein as "guide polynucleotide" and "gRNA"). A targetable nuclease system can include a nucleic acid-guided nuclease or a polynucleotide sequence encoding the nucleic acid-guided nuclease. A targetable nuclease system can include a guide nucleic acid or a polynucleotide sequence encoding the guide nucleic acid.

In general, a targetable nuclease system as disclosed herein can be characterized by elements that promote the formation of a targetable nuclease complex at the site of a target sequence, wherein the targetable nuclease complex includes a nucleic acid-guided nuclease and a guide nucleic acid.

A guide nucleic acid together with a nucleic acid-guided nuclease forms a targetable nuclease complex which is capable of binding to a target sequence within a target polynucleotide, as determined by the guide sequence of the guide nucleic acid.

In general, to generate a double stranded break, in most cases a targetable nuclease complex binds to a target sequence as determined by the guide nucleic acid, and the nuclease has to recognize a protospacer adjacent motif (PAM) sequence adjacent to the target sequence.

A targetable nuclease complex can include a nucleic acid-guided nuclease having an amino acid sequence of at least 50% identity to SEQ ID NO: 2 and a compatible guide nucleic acid. A targetable nuclease complex can include a nucleic acid-guided nuclease having an amino acid sequence of at least about 60%, 65%, 75%, 85%, 95%, 99% or about 100% identity to amino acid sequences SEQ ID NO: 2 and a compatible guide nucleic acid. protospacer adjacent motif (PAM) sequence adjacent to the target sequence. A targetable nuclease complex can include a nucleic acid-guided nuclease having an amino acid sequence of at least 50% identity to SEQ ID NO: 3 and a compatible guide nucleic acid. A targetable nuclease complex can include a nucleic acid-guided nuclease having an amino acid sequence of at least about 60%, 65%, 75%, 85%, 95%, 99% or about 100% identity to amino acid sequences of SEQ ID NO: 3 and a compatible guide nucleic acid. A targetable nuclease complex can include a nucleic acid-guided nuclease having an amino acid sequence of at least 50% identity to SEQ ID NO: 4 and a compatible guide nucleic acid. A targetable nuclease complex can include a nucleic acid-guided nuclease having an amino acid sequence of at least about 60%, 65%, 75%, 85%, 95%, 99% or about 100% identity to amino acid sequences of SEQ ID NO: 4 and a compatible guide nucleic acid. In certain embodiments, the guide nucleic acid can include a scaffold sequence compatible with the nucleic acid-guided nuclease selected. In any of these embodiments, the guide sequence can be engineered to be complementary to any desired target sequence. The guide sequence selected can be engineered to hybridize to any desired target sequence. In certain embodiments, the guide sequence is a dual guide RNA.

A target sequence of a targetable nuclease complex can be any polynucleotide endogenous or exogenous to a prokaryotic or eukaryotic cell, or in vitro. For example, the target sequence can be a polynucleotide residing in the nucleus of the eukaryotic cell. A target sequence can be a sequence coding a gene product (e.g., a protein) or a non-coding sequence (e.g., a regulatory polynucleotide or a junk DNA). It is contemplated herein that the target sequence should be associated with a PAM; that is, a short sequence recognized by a targetable nuclease complex. The precise sequence and length requirements for a PAM differ depending on the nucleic acid-guided nuclease used, but PAMs can be a 2-5 base pair sequences adjacent the target sequence. Examples of PAM sequences are given in the examples section below, and the skilled person will be able to identify further PAM sequences for use with a given nucleic acid-guided nuclease. Further, engineering of the PAM Interacting (PI) domain may allow programming of PAM specificity, improve target site recognition fidelity, and increase the versatility of a nucleic acid-guided nuclease genome engineering platform. Nucleic acid-guided nucleases may be engineered to alter their PAM specificity, for example as described in Kleinstiver et al., Nature. 2015 Jul. 23; 523 (7561): 481-5, the disclosure of which is incorporated herein in its entirety.

A PAM site is a nucleotide sequence in proximity to a target sequence. In most cases, a nucleic acid-guided nuclease can only cleave a target sequence if an appropriate PAM is present. PAMs are nucleic acid-guided nuclease-specific and can be different between two different nucleic acid-guided nucleases. A PAM can be 5' or 3' of a target sequence. A PAM can be upstream or downstream of a target sequence. A PAM can be 1, 2, 3, 4, 5, 6, 7, 8, 9, 10 or more nucleotides in length. Often, a PAM is between 2-6 nucleotides in length.

In some embodiments disclosed herein, a PAM can be provided on a separate oligonucleotide. In such cases, providing PAM on a oligonucleotide allows cleavage of a target sequence that otherwise would not be able to be cleave because no adjacent PAM is present on the same polynucleotide as the target sequence.

Polynucleotide sequences encoding a component of a targetable nuclease system can include one or more vectors. In general, the term "vector" as used herein can refer to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses). Other vectors (e.g., non-episomal mammalian vectors) can be integrated into the genome of a host cell upon introduction into the host cell. Recombinant expression vectors can include a nucleic acid of the invention in a form suitable for expression of the nucleic acid in a host cell, can mean that the recombinant expression vectors include one or more regulatory elements, which may be selected on the basis of the host cells to be used for expression, that is operatively-linked to the nucleic acid sequence to be expressed.

In some embodiments, a regulatory element can be operably linked to one or more elements of a targetable nuclease system so as to drive expression of the one or more components of the targetable nuclease system.

In some embodiments, a vector can include a regulatory element operably linked to a polynucleotide sequence encoding a nucleic acid-guided nuclease. The polynucleotide sequence encoding the nucleic acid-guided nuclease can be codon optimized for expression in targeted cells, such as prokaryotic or eukaryotic cells. Eukaryotic cells can be yeast, fungi, algae, plant, animal, or human cells. Eukaryotic cells can be those derived from an organism, such as a mammal, including but not limited to human, mouse, rat, rabbit, dog, or non-human mammal including non-human primate.

In general, codon optimization can refer to a process of modifying a nucleic acid sequence for enhanced expression in the host cells of interest by replacing at least one codon or more of the native sequence with codons that are more frequently or most frequently used in the genes of that host cell while maintaining the native amino acid sequence. Various species exhibit certain bias for codons of a certain amino acid. As contemplated herein, genes can be tailored for optimal gene expression in a given organism based on codon optimization. Codon usage tables are readily available, for example, at the "Codon Usage Database" available at www.kazusa.orjp and these tables can be adapted in a number of ways. See Nakamura, Y., et al. "Codon usage tabulated from the international DNA sequence databases: status for the year 2000" Nucl. Acids Res. 28:292 (2000).

A nucleic acid-guided nuclease and one or more guide nucleic acids can be delivered either as DNA or RNA. Delivery of a nucleic acid-guided nuclease and guide nucleic acid both as RNA (unmodified or containing base or backbone modifications) molecules can be used to reduce the amount of time that the nucleic acid-guided nuclease persists in the cell. This may reduce the level of off-target cleavage activity in the target cell. Since a nucleic acid-guided nuclease as mRNA takes time to be translated into protein, it can be advantageous to deliver the guide nucleic acid several hours following the delivery of the nucleic acid-guided nuclease mRNA, to maximize the level of guide nucleic acid available for interaction with the nucleic acid-guided nuclease protein. In other cases, the nucleic acid-guided nuclease mRNA and guide nucleic acid are delivered concomitantly. In other examples, the guide nucleic acid is delivered sequentially, such as 0.5, 1, 2, 3, 4, or more hours after the nucleic acid-guided nuclease mRNA.

Guide nucleic acid in the form of RNA or encoded on a DNA expression cassette can be introduced into a host cell can include a nucleic acid-guided nuclease encoded on a vector or chromosome. The guide nucleic acid may be provided in the cassette one or more polynucleotides, which may be contiguous or non-contiguous in the cassette. In specific embodiments, the guide nucleic acid is provided in the cassette as a single contiguous polynucleotide.

A variety of delivery systems can be used to introduce a nucleic acid-guided nuclease (DNA or RNA) and guide nucleic acid (DNA or RNA) into a host cell. In accordance with these embodiments, systems of use can include, but are not limited to, yeast systems, lipofection systems, microinjection systems, biolistic systems, virosomes, liposomes, immunoliposomes, polycations, lipid: nucleic acid conjugates, virions, artificial virions, viral vectors, electroporation, cell permeable peptides, nanoparticles, nanowires (Shalek et al., Nano Letters, 2012), exosomes. Molecular trojan horses liposomes (Pardridge et al., Cold Spring Harb Protoc; 2010; doi: 10.1101/pdb.prot5407) may be used to deliver an engineered nuclease and guide nuclease across the blood brain barrier.

In some embodiments, an editing template, also referred to herein as a donor template, is also provided. An editing template may be a component of a vector as described herein, contained in a separate vector, or provided as a separate polynucleotide, such as an oligonucleotide, linear polynucleotide, or synthetic polynucleotide. In some cases, an editing template is on the same polynucleotide as a guide nucleic acid. In some embodiments, an editing template is designed to serve as a template in homologous recombination, such as within or near a target sequence nicked or cleaved by a nucleic acid-guided nuclease as a part of a complex as disclosed herein. An editing template polynucleotide can be of any suitable length, such as about or more than about 10, 15, 20, 25, 50, 75, 100, 150, 200, 500, 1000, or more nucleotides in length. In some embodiments, the editing template polynucleotide is complementary to a portion of a polynucleotide can include the target sequence. When optimally aligned, an editing template polynucleotide might overlap with one or more nucleotides of a target sequences (e.g. about or more than about 1, 5, 10, 15, 20, 25, 30, 35, 40, or more nucleotides). In some embodiments, when a editing template sequence and a polynucleotide can include a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence.

In some embodiments, methods are provided for delivering one or more polynucleotides, such as or one or more vectors or linear polynucleotides as described herein, one or more transcripts thereof, and/or one or proteins transcribed therefrom, to a host cell. In some aspects, the invention further provides cells produced by such methods, and organisms can include or produced from such cells. In some embodiments, an engineered nuclease in combination with (and optionally complexed with) a guide nucleic acid is delivered to a cell.

Conventional viral and non-viral based gene transfer methods can be used to introduce nucleic acids in cells, such as prokaryotic cells, eukaryotic cells, mammalian cells, or target tissues. Such methods can be used to administer nucleic acids encoding components of an engineered nucleic acid-guided nuclease system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. Any gene therapy method known in the art is contemplated of use herein. Methods of non-viral delivery of nucleic acids include are contemplated herein. Adeno-associated virus ("AAV") vectors may also be used to transduce cells with target nucleic acids, e.g., in the in vitro production of nucleic acids and peptides, and for in vivo and ex vivo gene therapy procedures.

In some embodiments, a host cell is transiently or non-transiently transfected with one or more vectors, linear polynucleotides, polypeptides, nucleic acid-protein complexes, or any combination thereof as described herein. In some embodiments, a cell in transfected in vitro, in culture, or ex vivo. In some embodiments, a cell is transfected as it naturally occurs in a subject. In some embodiments, a cell that is transfected is taken from a subject. In some embodiments, the cell is derived from cells taken from a subject, such as a cell line.

In some embodiments, a cell transfected with one or more vectors, linear polynucleotides, polypeptides, nucleic acid-protein complexes, or any combination thereof as described herein is used to establish a new cell line can include one or more transfection-derived sequences. In some embodiments, a cell transiently transfected with the components of an engineered nucleic acid-guided nuclease system as described herein (such as by transient transfection of one or more vectors, or transfection with RNA), and modified through the activity of an engineered nuclease complex, is used to establish a new cell line can include cells containing the modification but lacking any other exogenous sequence.

In some embodiments, one or more vectors described herein are used to produce a non-human transgenic cell, organism, animal, or plant. In some embodiments, the transgenic animal is a mammal, such as a mouse, rat, or rabbit. Methods for producing transgenic cells, organisms, plants, and animals are known in the art, and generally begin with a method of cell transformation or transfection, such as described herein.

In certain embodiments, an engineered nuclease complex, "target sequence" can refer to a sequence to which a guide sequence is designed to have complementarity, where hybridization between a target sequence and a guide sequence promotes the formation of an engineered nuclease complex. A target sequence can include any polynucleotide, such as DNA, RNA, or a DNA-RNA hybrid. A target sequence can be located in the nucleus or cytoplasm of a cell. A target sequence can be located in vitro or in a cell-free environment.

In some embodiments, formation of an engineered nuclease complex can include a guide nucleic acid hybridized to a target sequence and complexed with one or more novel engineered nucleases as disclosed herein renders cleavage of one or both strands in or near (e.g. within 1, 2, 3, 4, 5, 6, 7, 8, 9, 10, 20, 30, 40, 50, or more base pairs from) the targeted sequence. Cleavage can occur within a target sequence, 5' of the target sequence, upstream of a target sequence, 3' of the target sequence, or downstream of a target sequence.

In some embodiments, one or more vectors driving expression of one or more components of a targetable nuclease system are introduced into a host cell or in vitro such formation of a targetable nuclease complex at one or more target sites. For example, a nucleic acid-guided nuclease and a guide nucleic acid can each be operably linked to separate regulatory elements on separate vectors. Alternatively, two or more of the elements expressed from the same or different regulatory elements, can be combined in a single vector, with one or more additional vectors providing any components of the targetable nuclease system not included in the first vector. Targetable nuclease system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-guided nuclease and one or more guide nucleic acids. In some embodiments, a nucleic acid-guided nuclease and one or more guide nucleic acids are operably linked to and expressed from the same promoter. In other embodiments, one or more guide nucleic acids or polynucleotides encoding the one or more guide nucleic acids are introduced into a cell or in vitro environment already can include a nucleic acid-guided nuclease or polynucleotide sequence encoding the nucleic acid-guided nuclease.

In some embodiments, when multiple different guide sequences are used, a single expression construct may be used to target nuclease activity to multiple different, corresponding target sequences within a cell or in vitro. For example, a single vector can include about or more than about 1, 2, 3, 4, 5, 6, 7, 8, 9, 10, 15, 20, or more guide sequences. In other embodiments, about or more than about 1, 2, 3, 4, 5, 6, 7, 8, 9, 10, or more such guide-sequence-containing vectors can be provided, and optionally, delivered to a cell in vivo or in vitro.

In some embodiments, methods and compositions disclosed herein can include more than one guide nucleic acid, such that each guide nucleic acid has a different guide sequence, thereby targeting a different target sequence. In accordance with these embodiments, multiple guide nucleic acids can be using in multiplexing, wherein multiple targets are targeted simultaneously. Additionally or alternatively, the multiple guide nucleic acids are introduced into a population of cells, such that each cell in a population received a different or random guide nucleic acid, thereby targeting multiple different target sequences across a population of cells. In such cases, the collection of subsequently altered cells can be referred to as a library.

In other embodiments, methods and compositions disclosed herein can include multiple different nucleic acid-guided nucleases, each with one or more different corresponding guide nucleic acids, thereby allowing targeting of different target sequences by different nucleic acid-guided nucleases. In some such cases, each nucleic acid-guided nuclease can correspond to a distinct plurality of guide nucleic acids, allowing two or more non-overlapping, partially overlapping, or completely overlapping multiplexing events.

In some embodiments, the nucleic acid-guided nuclease has DNA cleavage activity or RNA cleavage activity. In some embodiments, the nucleic acid-guided nuclease directs cleavage of one or both strands at the location of a target sequence, such as within the target sequence and/or within the complement of the target sequence. In some embodiments, the nucleic acid-guided nuclease directs cleavage of one or both strands within about 1, 2, 3, 4, 5, 6, 7, 8, 9, 10, 15, 20, 25, 50, 100, 200, 500, or more base pairs from the first or last nucleotide of a target sequence.

In certain embodiments, the invention provides for methods of modifying a target sequence in vitro, or in a prokaryotic or eukaryotic cell, which can be in vivo, ex vivo, or in vitro. In some embodiments, the method includes sampling a cell or population of cells such as prokaryotic cells, or those from a human or non-human animal or plant (including micro-algae or other organism), and modifying the cell or cells. Culturing may occur at any stage in vitro or ex vivo. The cell or cells may even be re-introduced into the host, such as a non-human animal or plant (including micro-algae). For re-introduced cells, they can be stem cells.

In some embodiments, the method includes allowing a targetable nuclease complex to bind to the target sequence to effect cleavage of the target sequence, thereby modifying the target sequence, wherein the targetable nuclease complex includes a nucleic acid-guided nuclease complexed with a guide nucleic acid wherein the guide sequence of the guide nucleic acid is hybridized to a target sequence within a target polynucleotide. In some aspects, the invention provides a method of modifying expression of a target polynucleotide in in vitro or in a prokaryotic or eukaryotic cell. In some embodiments, the method includes allowing an targetable nuclease complex to bind to a target sequence with the target polynucleotide such that the binding can lead to in increased or decreased expression of the target polynucleotide; wherein the targetable nuclease complex includes an nucleic acid-guided nuclease complexed with a guide nucleic acid, and wherein the guide sequence of the guide nucleic acid is hybridized to a target sequence within the target polynucleotide.

In certain embodiments, the invention provides kits containing any one or more of the elements disclosed in the above methods and compositions. Elements may provide individually or in combinations, and may be provided in any suitable container, such as a vial, a bottle, or a tube. In some embodiments, the kit includes instructions in one or more languages, for example in more than one language.

In some embodiments, a kit comprises one or more reagents for use in a process utilizing one or more of the elements described herein. Reagents may be provided in any suitable container. For example, a kit may provide one or more reaction or storage buffers. Reagents can be provided in a form that is usable in an assay, or in a form that requires addition of one or more other components before use (e.g. in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10. In some embodiments, the kit includes one or more oligonucleotides corresponding to a guide sequence for insertion into a vector so as to operably link the guide sequence and a regulatory element. In some embodiments, the kit includes a editing template.

In some embodiments, a targetable nuclease complex has a wide variety of utility including modifying (e.g., deleting, inserting, translocating, inactivating, activating) a target sequence in a multiplicity of cell types. As such a targetable nuclease complex of the invention has a broad spectrum of applications in, e.g., biochemical pathway optimization, genome-wide studies, genome engineering, gene therapy, drug screening, disease diagnosis, and prognosis. An exemplary targetable nuclease complex includes a nucleic acid-guided nuclease as disclosed herein complexed with a guide nucleic acid, wherein the guide sequence of the guide nucleic acid can hybridize to a target sequence within the target polynucleotide. A guide nucleic acid can include a guide sequence linked to a scaffold sequence. A scaffold sequence can include one or more sequence regions with a degree of complementarity such that together they form a secondary structure.

An editing template polynucleotide can include a sequence to be integrated (e.g., a mutated gene). A sequence for integration may be a sequence endogenous or exogenous to the cell. Examples of a sequence to be integrated include polynucleotides encoding a protein or a non-coding RNA (e.g., a microRNA). Thus, the sequence for integration may be operably linked to an appropriate control sequence or sequences. Alternatively, the sequence to be integrated may provide a regulatory function. Sequence to be integrated may be a mutated or variant of an endogenous wild-type sequence. Alternatively, sequence to be integrated may be a wild-type version of an endogenous mutated sequence. Additionally or alternatively, sequenced to be integrated may be a variant or mutated form of an endogenous mutated or variant sequence.

In certain embodiments, an upstream or downstream sequence can include from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or about 2500 bp. In some embodiments, an exemplary upstream or downstream sequence has about 15 bp to about 2000 bp, about 30 bp to about 1000 bp, about 50 bp to about 750 bp, about 600 bp to about 1000 bp, or about 700 bp to about 1000 bp.

In some embodiments, the editing template polynucleotide can further include a marker. In certain embodiments, some markers can facilitate screening for targeted integrations. Examples of suitable markers can include, but are not limited to, restriction sites, fluorescent proteins, or selectable markers. In certain embodiments, an exogenous polynucleotide template can be constructed using recombinant techniques.

In one embodiment, an exemplary method for modifying a target polynucleotide by integrating an editing template polynucleotide, a double stranded break is introduced into the genome sequence by an engineered nuclease complex, the break can be repaired via homologous recombination using an editing template such that the template is integrated into the target polynucleotide. The presence of a double-stranded break can increase the efficiency of integration of the editing template.

Disclosed herein are methods for modifying expression of a polynucleotide in a cell. Some methods include increasing or decreasing expression of a target polynucleotide by using a targetable nuclease complex that binds to the target polynucleotide.

Detection of the gene expression level can be conducted in real time in an amplification assay. In one aspect, the amplified products can be directly visualized with fluorescent DNA-binding agents including but not limited to DNA intercalators and DNA groove binders. Because the amount of the intercalators incorporated into the double-stranded DNA molecules can be proportional to the amount of the amplified DNA products, one can conveniently determine the amount of the amplified products by quantifying the fluorescence of the intercalated dye using conventional optical systems in the art. DNA-binding dye suitable for this application include, but are not limited to, SYBR green, SYBR blue, DAPI, propidium iodine, Hoeste, SYBR gold, ethidium bromide, acridines, proflavine, acridine orange, acriflavine, fluorcoumanin, ellipticine, daunomycin, chloroquine, distamycin D, chromomycin, homidium, mithramycin, ruthenium polypyridyls, anthramycin, and others known by one of skill in the art.

In some embodiments, other fluorescent labels such as sequence specific probes can be employed in the amplification reaction to facilitate the detection and quantification of the amplified products. Probe-based quantitative amplification relies on the sequence-specific detection of a desired amplified product. It utilizes fluorescent, target-specific probes (e.g., TaqMan™ probes) resulting in increased specificity and sensitivity. Methods for performing probe-based quantitative amplification are well established in the art.

In some embodiments, an agent-induced change in expression of sequences associated with a signaling biochemical pathway can also be determined by examining the corresponding gene products. Determining the protein level can involve a) contacting the protein contained in a biological sample with an agent that specifically bind to a protein associated with a signaling biochemical pathway; and (b) identifying any agent: protein complex so formed. In one aspect of this embodiment, the agent that specifically binds a protein associated with a signaling biochemical pathway is an antibody, preferably a monoclonal antibody.

In some embodiments, the amount of agent:polypeptide complexes formed during the binding reaction can be quantified by standard quantitative assays. As illustrated above, the formation of agent:polypeptide complex can be measured directly by the amount of label remained at the site of binding. In an alternative, the protein associated with a signaling biochemical pathway is tested for its ability to compete with a labeled analog for binding sites on the specific agent. In this competitive assay, the amount of label captured is inversely proportional to the amount of protein sequences associated with a signaling biochemical pathway present in a test sample.

In some embodiments, a number of techniques for protein analysis based on the general principles outlined above are known in the art and contemplated herein. They include but are not limited to radioimmunoassays, ELISA (enzyme linked immunoradiometric assays), "sandwich" immunoassays, immunoradiometric assays, in situ immunoassays (using e.g., colloidal gold, enzyme or radioisotope labels), western blot analysis, immunoprecipitation assays, immunofluorescent assays, and SDS-PAGE.

In some embodiments, in practicing a subject method, it may be desirable to discern the expression pattern of a protein associated with a signaling biochemical pathway in different bodily tissue, in different cell types, and/or in different subcellular structures. These studies can be performed with the use of tissue-specific, cell-specific or subcellular structure specific antibodies capable of binding to protein markers that are preferentially expressed in certain tissues, cell types, or subcellular structures.

In other embodiment, an altered expression of a gene associated with a signaling biochemical pathway can also be determined by examining a change in activity of the gene product relative to a control cell. The assay for an agent-induced change in the activity of a protein associated with a signaling biochemical pathway will dependent on the biological activity and/or the signal transduction pathway that is under investigation. For example, where the protein is a kinase, a change in its ability to phosphorylate the downstream substrate(s) can be determined by a variety of assays known in the art. Representative assays include but are not limited to immunoblotting and immunoprecipitation with antibodies such as anti-phosphotyrosine antibodies that recognize phosphorylated proteins. In addition, kinase activity can be detected by high throughput chemiluminescent assays.

In certain embodiments, where the protein associated with a signaling biochemical pathway is part of a signaling cascade leading to a fluctuation of intracellular pH condition, pH sensitive molecules such as fluorescent pH dyes can be used as the reporter molecules. In another example where the protein associated with a signaling biochemical pathway is an ion channel, fluctuations in membrane potential and/or intracellular ion concentration can be monitored. A number of commercial kits and high-throughput devices are suited for a rapid and robust screening for modulators of ion channels. Representative instruments include FLIPR™ (Molecular Devices, Inc.) and VIPR (Aurora Biosciences). These instruments are capable of detecting reactions in over 1000 sample wells of a microplate simultaneously, and providing real-time measurement and functional data within a second or even a millisecond.

In practicing any of the methods disclosed herein, a suitable vector can be introduced to a cell, tissue, organism, or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

A target polynucleotide of a targetable nuclease complex can be any polynucleotide endogenous or exogenous to the host cell. For example, the target polynucleotide can be a polynucleotide residing in the nucleus of the eukaryotic cell, the genome of a prokaryotic cell, or an extrachromosomal vector of a host cell. The target polynucleotide can be a sequence coding a gene product (e.g., a protein) or a non-coding sequence (e.g., a regulatory polynucleotide or a junk DNA).

Some embodiments disclosed herein relate to use of an engineered nucleic acid guided nuclease system disclosed herein; for example, in order to target and knock out genes, amplify genes and/or repair certain mutations associated with DNA repeat instability and a medical disorder. This nuclease system may be used to harness and to correct these defects of genomic instability. In other embodiments, engineered nucleic acid guided nuclease systems disclosed herein can be used for correcting defects in the genes associated with Lafora disease. Lafora disease is an autosomal recessive condition which is characterized by progressive myoclonus epilepsy which may start as epileptic seizures in adolescence. This condition causes seizures, muscle spasms, difficulty walking, dementia, and eventually death.

In yet another aspect of the invention, the engineered/novel nucleic acid guided nuclease system can be used to correct genetic-eye disorders that arise from several genetic mutations In certain embodiments disclosed herein engineered nucleic acid guided nuclease constructs can recognize a protospacer adjacent motif (PAM) sequence other than TTTN or in addition to TTTN. In other embodiments, engineered nucleic acid guided nuclease constructs disclosed herein can be further mutated to improve targeting efficiency or can be selected from a library for certain targeted features. Other embodiments disclosed herein concern vectors including constructs disclosed herein of use for further analysis and to select for improved genome editing features.

Other embodiments disclosed herein include kits for packaging and transporting nucleic acid guided nuclease constructs and/or novel gRNAs disclosed herein or known gRNAs disclosed herein and further include at least one container. In certain embodiments, several reagents required for the kits can be included for convenience and ease of transport and efficiency.

EXAMPLES

Example 1: Culture of Jurkat Human T-Cell Leukemia Cell Line and Primary Human T-Cells Human Jurkat T-cell leukemia cells (Leibniz Institute DSMZ-German Collection of Microorganisms and Cell Cultures GmbH (ACC 282)) were propagated in RPMI 1640 medium (ThermoFisher Scientific) with 10% heat-inactivated fetal bovine serum (FBS) (ThermoFisher Scientific) supplemented with 1% penicillin-streptomycin antibiotic mix (ThermoFisher Scientific). Cells were cultured at 37° C. in 5% CO2 incubators and maintained at a density of 0.5 to $1.5\times10^6$ cells $mL^{-1}$. 24 hours before transfection, cells were passaged at $0.1\times10^6$ cell $mL^{-1}$. Cell culture media supernatant was periodically tested for *mycoplasma* contamination using the MycoAlert PLUS *mycoplasma* detection kit (Lonza).

Example 2: Primary T-Cell Isolation and Culture

T-cells were isolated from human peripheral blood obtained from healthy adults by immune-magnetic negative selection using the EasySep Human T-cell Isolation Kit (STEMCELL Technologies). After isolation, T-cells were activated in 25 μL $mL^{-1}$ ImmunoCult Human CD3/CD28/CD2 T-Cell Activator (STEMCELL Technologies) in ImmunoCult-XF T-Cell Expansion Medium (STEMCELL Technologies) containing 12.5 ng $mL^{-1}$ Human Recombinant IL-2, 5 ng $mL^{-1}$ IL-7, and 5 ng $mL^{-1}$ IL-15 (STEMCELL Technologies) and seeded at $1.0\times10^6$ cells mL-1. Until transfection 48 hours later, the cells were cultured at 37° C. in 5% CO2 incubators.

Example 3: RNP Formulation

Ribonucleoprotein complexes (RNPs) were generated by incubating respective guide nucleic acids (gNAs) with MAD7 in the molar ratio of 3:2 gNA:MAD7 for 15 minutes at room temperature immediately before transfection. For Jurkat experiments, the RNP complexes were generated by mixing the respective gNA (150 μmol), MAD7 (100 μmol), and nuclease-free water, unless otherwise stated. For T-cell experiments, 1.6 μL of an aqueous solution of 15-50 kDa poly-L-glutamic acid (PGA, 100 μg $\mu L^{-1}$, Alamanda Polymers) was added to gNAs, followed by the addition of MAD7 and nuclease-free water.

Example 4: Generation of Donor Templates Via PCT Amplification

Donor templates comprising site-specific homology arms, respective promoter, and respective gene (GFP or Hu19 scFv-CD8a-CD28-CD3ζ CAR) were amplified from corresponding pTwist Ampicillin high-copy plasmids (Twist Bioscience) using homology arms-specific PCR primers. Donor templates were amplified in a two-step PCR program: initial denaturation at 98° C. for 30 seconds, cycle denaturation at 98° C. for 10 seconds, extension at 72° C. for 30 seconds per kb amplicon for 40-cycles with a hold at 72° C. for 10 minutes. Each 50 μL PCR reaction contained 10 ng amplification template (plasmid DNA), 0.5 μM homology arm-specific forward and reverse primers, nuclease-free water (IDT), 3% DMSO, and 1× Phusion High-Fidelity PCR Master Mix with HF Buffer (ThermoFisher Scientific). PCR products were purified using NucleoSpin Gel and PCR Clean-up Kit (Macherey-Nagel) with two 20 μL elutions. Purified HDR templates were collected and quantified on NanoDrop One Microvolume UV-Vis Spectrophotometer (ThermoFisher Scientific). Templates were concentrated using Amicon Ultra 0.5 mL 30K Centrifugal Filters: 100 μg DNA per unit was transferred, filled with nuclease-free water to 500 μL, and centrifuged at 10,000 g for 10 minutes to reduce volume to 50 μL. DNA was washed twice with nuclease-free water and recovered into a fresh tube by inversion and centrifugation at 10,000 g for 15 seconds. HDR templates were collected, diluted, and concentrations quantified using Qubit dsDNA HS Assay Kit (ThermoFisher Scientific). HDR templates of 0.5 to 1 μg $\mu L^{-1}$ were used for cellular studies.

Example 5: Jurkat Cell Transfection

Lonza 4D Nucleofector with Shuttle unit (V4SC-2960 Nucleocuvette Strips) was used for transfection, following the manufacturer's instructions. For transfection, cells were harvested by centrifugation (200 g, RT, 5 minutes) and re-suspended in 20 μL at $10\times10^6$ cells $mL^{-1}$ in the SF Cell Line Nucleofector X Kit buffer (Lonza), unless stated otherwise. The cell suspension was mixed with the RNPs, immediately transferred to the nucleocuvette, and transfected. After transfection, the cells were immediately re-suspended in the pre-warmed cultivation medium and plated onto 96-well, flat-bottom, non-cell culture treated plates (Falcon), and cultured at 37° C. in 5% $CO_2$ incubators and maintained at a density of 0.5 to $1.0\times10^6$ cells $mL^{-1}$. After 48 hours, the cells were harvested for the viability assay and genomic DNA, as described below. For the Homology-Directed Repair Template insertion, the HDR template was added to the cells and the suspension transferred to the RNPs immediately before transfection. The transfection parameters, cell recovery step, and proliferation conditions as described in Example 1. The cells were harvested 48 hours post-transfection for the viability assessment, after 7 days for CAR insertion efficiency, or after 7 days, 14 days, and 21 days for GFP insertion efficiency.

Example 6: Primary T-Cell Transfection 48 hours after isolation, the cells were harvested by centrifugation (300 g, RT, 5 minutes) and re-suspended in 20 μL at $50\times10^6$ cells $mL^{-1}$ in the supplemented P3 Primary Cell Nucleofector Kit buffer (Lonza). The cells were mixed with HDR templates and the suspension transferred to the RNPs immediately before transfection (Nucleofection program EH-115). After transfection, 80 μL of pre-warmed cultivation medium without IL-2 was added to the electroporation cuvettes. When using M3814 (Selleckchem), 80 μL of pre-warmed cultivation medium containing 2 μM M3814 final concentration without IL-2 was added to the electroporation cuvettes. After 10 minutes of incubation at 37° C., T-cells were transferred onto 96-well, flat-bottom, non-cell culture treated plates (Falcon) containing pre-warmed cultivation medium pretreated with 2 μM M3814 final concentration and 12.5 ng $mL^{-1}$ IL-2. The cells were seeded at a density of $0.25\times10^6$ cells mL-1, or $1.3\times10^6$ cells $mL^{-1}$ in the experiment with M3814, and kept at 37° C. in 5% $CO_2$ incubators. The viability assay was carried out 24 hours post-transfection after which the cells were reseeded in the fresh cultivation medium containing IL-2. Insertion efficiency of CAR was measured after 7 days, and 11 days or 13 days post-transfection.

Example 7: Flow Cytometry

Flow cytometric assessments were carried out on a CytoFLEX S instrument (Beckmen Coulter) using a 96-well plate format. Measurements of cell viability, PDCD1 expression, GFP expression, and CAR expression were performed on 10,000 or 20,000 single cell events in Jurkat or primary T-cells, respectively.

For the cell viability and GFP knock-in measurements, approximately 250,000 cells per sample were transferred onto 96-well V-bottom cell culture plates and assessed following a series of consecutive washing and staining steps. The first step included centrifuging the cells at 300 g for 5 minutes at room temperature, discarding the supernatant, and washing cells in 150 μL Dulbecco's PBS/2% FBS (STEMCELL Technologies) or Cell Staining Buffer (Biolegend), respectively, followed by the second centrifugation and removal of supernatant. The final step included viability staining of cells using 150 μL Dulbecco's PBS/2% FBS with 7-amino-actinomycin D (7-AAD, 1:1,000; ThermoFisher) or 50 μL Cell Staining Buffer with Zombie Violet Dye (1:200; Biolegend), respectively. The measurements of cell viability and GFP expression were collected simultaneously for 7-AAD (excitation: yellow-green laser; emission: 561 nm), Zombie Violet (excitation: violet laser; emission 405 nm), and GFP (excitation: blue laser; emission 488 nm) as needed.

For detection of CAR knock-in efficiency, approx. 250,000 cells per sample were transferred onto 96-well V-bottom, washed as described above using Cell Staining Buffer, and re-suspended in 50 μL Cell Staining Buffer with PE Anti-Myc tag antibody [9E10] (1:50; Abcam) and Zombie Violet Dye (1:200; Biolegend) for 30 minutes. Afterwards, the cells were washed in two subsequent washing steps using 150 μL Cell Staining Buffer, and finally re-suspended in 100 μL Cell Staining Buffer for the flow cytometry measurements (excitation: yellow-green laser; emission: 561 nm).

For detection of PDCD1 knock-out efficiency, approx. 250,000 Jurkat cells per sample were transferred onto 96-well V-bottom cell culture plates and assessed following a series of consecutive washing and staining steps. The first step included centrifuging the cells at 300 g for 5 minutes at 4° C. and discarding the supernatant. Afterwards, the cells were stained using 100 μL Cell Staining Buffer (Biolegend) with APC/Cyanine7 anti-human CD279 (PD-1) antibody (1:100; Biolegend) and incubated for 30 minutes at 4° C. in the dark. The cells were then centrifuged at 300 g for 5 minutes at 4° C. and the supernatant discarded. The next step included two repeats of centrifugation at 300 g for 5 minutes at 4° C., supernatant removal, and cell washing in 150 μL ice-cold Cell Staining Buffer (Biolegend). In the final step, the cells were re-suspended in 100 μL Cell Staining Buffer for the flow cytometry measurements (excitation: red laser; emission: 633 nm).

Example 8: DNA Extraction

Cells were harvested 48-h post-transfection by centrifugation (1,000 g, 10 minutes) in 96-well, V-bottom plates (Greiner), washed with PBS (Sigma Aldrich) and lysed in 20 μL QuickExtract DNA Extraction Solution (Epicentre, Lucigen). DNA was extracted following the manufacturer's protocol: 15 minutes at 65° C., 15 minutes at 68° C., 10 minutes at 95° C., cooled to 4° C., and stored at 4° C. Genomic DNA was diluted 20-fold in nuclease-free water before amplicon PCR reactions.

Example 9: Amplicon Sequencing

Extracted genomic DNA was quantified using the NanoDrop (ThermoFisher Scientific). Amplicons were constructed in two PCR steps: in the first PCR, regions of interest (150-400 bp) were amplified from 10 to 30 ng of genomic DNA with primers containing Illumina forward and reverse adapters on both ends comprising suitable loci-specific complementary sequences, using Phusion High-Fidelity PCR Master Mix (ThermoFisher Scientific). Amplification products were purified with Agencourt AMPure XP beads (Ramcon), using the sample to beads ratio of 1:1.8. The DNA was eluted from the beads with nuclease-free water and the size of the purified amplicons analyzed on a 2% agarose E-gel using the E-gel electrophoresis system (ThermoFisher Scientific). In the second PCR, unique pairs of Illumina-compatible indexes (Nextera XT Index Kit v2) were added to the amplicons using the KAPA HiFi HotStart Ready Mix (Roche). The amplified products were purified with Agencourt AMPure XP beads (Ramcon), using the sample to bead ratio of 1:1.8. The DNA was eluted from the beads with 10 mM Tris-HCl pH 8.5, 0.1% Tween 20. Sizes of the purified DNA fragments were validated on a 2% agarose gel using the E-gel electrophoresis system (ThermoFisher Scientific), quantified using Qubit dsDNA HS Assay Kit (Thermo Fisher) and then pooled in equimolar concentrations. Quality of the amplicon library was validated using Bioanalyzer, High Sensitivity DNA Kit (Agilent) before sequencing. The final library was sequenced on Illumina MiSeq System using the MiSeq Reagent Kit v.2 (300 cycles, 2×250 bp, paired-end reads). De-multiplexed FASTQ files were obtained from BaseSpace (Illumina).

Example 10: NGS Data Analysis

Initial quality assessment of the obtained reads was performed with FastQC36. The sequencing data were aligned and analyzed with the CRISPResso2 software, using CRISPRessoBatch command with the parameters --cleavage_offset 1 --quantification_window_size 10 -- --quantification_window_center 1 --expand_ambiguous_alignments for the INDEL frequency analysis. For the ORF disruption analysis, CRISPRessoBatch command with the parameters --cleavage_offset 1 -coding_seq<EXON_SEQ>--quantification_window_size 0 --quantification_window_center 1 --expand_ambiguous_alignments was used. Modification rates from the CRISPResso2 software output were analyzed in Excel.

Example 11: CRISPR-MAD7 Platform for Human Genome Editing Using the Jurkat T-Cell Leukemia Line MAD7 nuclease comprising a His6 tag (SEQ ID NO: 423) and either one (MAD7-1NLS) or four (MAD7-4NLS) nuclear localization signals (NLS) were used (FIG. 1). RNPs were generated as described in Example 3. Editing frequency of the MAD7 nuclease complexed with one or more guide nucleic acids comprising a spacer sequence of SEQ ID NOs: 86-384 as shown in Table 1 was determined by nucleofection of RNPs in Jurkat T-cells using the Lonza recommended nucleofection program SE-CL-120 (Example 5), followed by genomic DNA extraction (Example 8), amplification of the edited locus and targeted next-generation sequencing (Example 9) for identification of the edits, and finally by computational analysis (Example 10) of modification frequency using the CRISPResso2 algorithm.

TABLE 1

Spacer sequences

| Name | PAM | SEQ ID NO | Spacer sequence |
|---|---|---|---|
| crCD247_1 | TTTC | 114 | ACCGCGGCCAUCCUGCAGGCA |
| crCD247_2 | TTTC | 115 | UGAGGGAAAGGACAAGAUGAA |
| crCD247_3 | TTTG | 116 | GGAUCCAGCAGGCCAAAGCUC |
| crCD247_4 | TTTC | 117 | CUAGCAGAGAAGGAAGAACCC |
| crCD247_5 | TTTC | 118 | UGUGUUGCAGUUCAGCAGGAG |
| crCD247_6 | CTTC | 119 | CUGAGGGUUCUUCCUUCUCUG |
| crCD247_7 | CTTC | 120 | CCGUUGUCUUUCCUAGCAGAG |
| crCD247_8 | TTTC | 121 | UGCAGUUCCUGCAGAAGAGGG |
| crCD247_9 | CTTC | 122 | UGCAGGAACUGCAGAAAGAUA |
| crCD247_10 | TTTC | 123 | AUCCCAAUCUCACUGUAGGCC |
| crCD247_11 | CTTT | 124 | CAUCCCAAUCUCACUGUAGGC |
| crCD247_12 | TTTT | 125 | CUCAUUUCACUCCCAAACAAC |
| crCD247_13 | TTTC | 126 | UCAUUUCACUCCCAAACAACC |
| crCD247_14 | TTTC | 127 | ACUCCCAAACAACCAGCGCCG |
| crCD247_15 | CTTA | 128 | CGUUAUAGAGCUGGUUCUGGC |
| crCD247_16 | TTTG | 129 | UUUUCUGAUUUGCUUUCACGC |
| crCD247_17 | TTTC | 130 | UGAUUUGCUUUCACGCCAGGG |
| crCD247_18 | TTTG | 131 | CUUUCACGCCAGGGUCUCAGU |

TABLE 1-continued

Spacer sequences

| Name | PAM | SEQ ID NO | Spacer sequence |
|---|---|---|---|
| crCD247_19 | TTTC | 132 | ACGCCAGGGUCUCAGUACAGC |
| crCD247_20 | TTTC | 133 | CGGAGGGUCUACGGCGAGGCU |
| crCD247_21 | TTTC | 134 | UUAUCUGUUAUAGGAGCUCAA |
| crCD247_22 | CTTA | 135 | UCUGUUAUAGGAGCUCAAUCU |
| crCD247_23 | CTTG | 136 | UCCAAAACAUCGUACUCCUCU |
| crCD247_24 | TTTC | 137 | CCCCCAUCUCAGGGUCCCGGC |
| crCD247_25 | TTTG | 138 | GACAAGAGACGUGGCCGGGAC |
| crCD247_26 | TTTC | 139 | UCUCCCUCUAACGUCUUCCCG |
| crCTLA4_1 | TTTG | 140 | CCUGGAGAUGCAUACUCACAC |
| crCTLA4_2 | TTTG | 141 | CAGAAGACAGGGAUGAAGAGA |
| crCTLA4_3 | TTTC | 142 | CACUGGAGGUGCCCGUGCAGA |
| crCTLA4_4 | TTTG | 143 | UGUGUGAGUAUGCAUCUCCAG |
| crCTLA4_5 | TTTC | 144 | AGCGGCACAAGGCUCAGCUGA |
| crCTLA4_6 | CTTG | 145 | UGCCGCUGAAAUCCAAGGCAA |
| crCTLA4_7 | CTTT | 146 | UCCAUGCUAGCAAUGCACGUG |
| crCTLA4_8 | TTTT | 147 | CCAUGCUAGCAAUGCACGUGG |
| crCTLA4_9 | CTTT | 148 | GUGUGUGAGUAUGCAUCUCCA |
| crCTLA4_10 | CTTT | 149 | GCCUGGAGAUGCAUACUCACA |
| crCTLA4_11 | CTTC | 150 | GGCAGGCUGACAGCCAGGUGA |
| crCTLA4_12 | CTTC | 151 | AGUCACCUGGCUGUCAGCCUG |
| crCTLA4_13 | CTTC | 152 | CUAGAUGAUUCCAUCUGCACG |
| crCTLA4_14 | CTTG | 153 | CCUUGGAUUUCAGCGGCACAA |
| crCTLA4_15 | CTTG | 154 | AUUUCCACUGGAGGUGCCCGU |
| crCTLA4_16 | CTTG | 155 | GAUAGUGAGGUUCACUUGAUU |
| crCTLA4_17 | CTTG | 156 | CAGAUGUAGAGUCCCGUGUCC |
| crCTLA4_18 | TTTG | 157 | CUCACCAAUUACAUAAAUCUG |
| crCTLA4_19 | CTTT | 158 | GCUCACCAAUUACAUAAAUCU |
| crCTLA4_20 | CTTT | 159 | GUUUUCUGUUGCAGAUCCAGA |
| crCTLA4_21 | TTTG | 160 | UUUUCUGUUGCAGAUCCAGAA |
| crCTLA4_22 | TTTT | 161 | CUGUUGCAGAUCCAGAACCGU |
| crCTLA4_23 | CTTC | 162 | CUCCUCUGGAUCCUUGCAGCA |
| crCTLA4_24 | CTTG | 163 | CAGCAGUUAGUUCGGGGUUGU |
| crCTLA4_25 | CTTG | 164 | GAUUUCAGCGGCACAAGGCUC |
| crCTLA4_26 | TTTT | 165 | UUUAUAGCUUUCUCCUCACAG |
| crCTLA4_27 | CTTT | 166 | CUCCUCACAGCUGUUUCUUUG |
| crCTLA4_28 | TTTC | 167 | UCCUCACAGCUGUUUCUUUGA |
| crCTLA4_29 | TTTT | 168 | GCUCAAAGAAACAGCUGUGAG |

TABLE 1-continued

Spacer sequences

| Name | PAM | SEQ ID NO | Spacer sequence |
|---|---|---|---|
| crCTLA4_30 | TTTC | 169 | UUUUUGUGUUUGACAGCUAAA |
| crCTLA4_31 | TTTT | 170 | UGUGUUUGACAGCUAAAGAAA |
| crCTLA4_32 | TTTG | 171 | ACAGCUAAAGAAAAGAAGCCC |
| crCTLA4_33 | TTTT | 172 | CACAUAGACCCCUGUUGUAAG |
| crCTLA4_34 | TTTT | 173 | CACAUUCUGGCUCUGUUGGGG |
| crCTLA4_35 | CTTT | 174 | UCACAUUCUGGCUCUGUUGGG |
| crCTLA4_36 | TTTC | 175 | AGCCUUAUUUUAUUCCCAUCA |
| crCTLA4_37 | TTTC | 176 | UCAAUUGAUGGGAAUAAAAUA |
| crCTLA4_38 | TTTT | 177 | UUCUUCUCUUCAUCCCUGUCU |
| crCTLA4_39 | CTTT | 178 | GCAGAAGACAGGGAUGAAGAG |
| crCTLA4_40 | CTTT | 179 | GGCUUUUCCAUGCUAGCAAUG |
| crCTLA4_41 | TTTG | 180 | GCUUUUCCAUGCUAGCAAUGC |
| crLAG3_1 | TTTG | 181 | GGGUGCAUACCUGUCUGGCUG |
| crLAG3_2 | TTTG | 182 | GGUCACCUGGAUCCCUGGGGA |
| crLAG3_3 | TTTC | 183 | UCAGGACCUUGGCUGGAGGCA |
| crLAG3_4 | TTTC | 184 | CCAGCCUUGGCAAUGCCAGCU |
| crLAG3_5 | TTTG | 185 | UGAGGUGACUCCAGUAUCUGG |
| crLAG3_6 | CTTG | 186 | CUGUUUCUGCAGCCGCUUUGG |
| crLAG3_7 | CTTG | 187 | CACAGUGACUGCCAGCCCCCC |
| crLAG3_8 | TTTT | 188 | GAACUGCUCCUUCAGCCGCCC |
| crLAG3_9 | CTTC | 189 | AGCCGCCCUGACCGCCCAGCC |
| crLAG3_10 | TTTC | 190 | CGCUAAGUGGUGAUGGGGGGA |
| crLAG3_11 | CTTT | 191 | CCGCUAAGUGGUGAUGGGGGG |
| crLAG3_12 | CTTA | 192 | GCGGAAAGCUUCCUCUUCCUG |
| crLAG3_13 | CTTG | 193 | GGGCAGGAAGAGGAAGCUUUC |
| crLAG3_14 | CTTC | 194 | CUCUUCCUGCCCCAAGUCAGC |
| crLAG3_15 | CTTC | 195 | AACGUCUCCAUCAUGUAUAAC |
| crLAG3_16 | TTTT | 196 | CUUUUCUCUUCAGGUCUGGAG |
| crLAG3_17 | TTTC | 197 | UGCAGCCGCUUUGGGUGGCUC |
| crLAG3_18 | TTTT | 198 | CUCUUCAGGUCUGGAGCCCCC |
| crLAG3_19 | CTTG | 199 | ACAGUGUACGCUGGAGCAGGU |
| crLAG3_20 | CTTG | 200 | GCAGUGAGGAAAGACCGGGUC |
| crLAG3_21 | TTTC | 201 | CUCACUGCCAAGUGGACUCCU |
| crLAG3_22 | CTTT | 202 | ACCCUUCGACUAGAGGAUGUG |
| crLAG3_23 | TTTA | 203 | CCCUUCGACUAGAGGAUGUGA |
| crLAG3_24 | CTTC | 204 | GACUAGAGGAUGUGAGCCAGG |
| crLAG3_25 | TTTC | 205 | CCACCUGAGGCUGACCUGUGA |

TABLE 1-continued

Spacer sequences

| Name | PAM | SEQ ID NO | Spacer sequence |
|---|---|---|---|
| crLAG3_26 | CTTT | 206 | CCCACCUGAGGCUGACCUGUG |
| crLAG3_27 | CTTC | 207 | UACUCUUUUCAGUGACUCCCA |
| crLAG3_28 | TTTT | 208 | ACCUGGAGCCACCCAAAGCGG |
| crLAG3_29 | TTTT | 209 | CAGUGACUCCCAAAUCCUUUG |
| crLAG3_30 | CTTC | 210 | CCCAGGGAUCCAGGUGACCCA |
| crLAG3_31 | CTTT | 211 | GGGUCACCUGGAUCCCUGGGG |
| crLAG3_32 | CTTT | 212 | GUGAGGUGACUCCAGUAUCUG |
| crLAG3_33 | CTTT | 213 | GUGUGGAGCUCUCUGGACACC |
| crLAG3_34 | TTTG | 214 | UGUGGAGCUCUCUGGACACCC |
| crLAG3_35 | CTTG | 215 | GCUGGAGGCACAGGAGGCCCA |
| crLAG3_36 | TTTT | 216 | GCUCACCUAGUGAAGCCUCUC |
| crLAG3_37 | CTTT | 217 | CCCAGCCUUGGCAAUGCCAGC |
| crLAG3_38 | CTTG | 218 | GCAAUGCCAGCUGUACCAGGG |
| crLAG3_39 | CTTC | 219 | UUGGAGCAGCAGUGUACUUCA |
| crLAG3_40 | CTTC | 220 | ACAGAGCUGUCUAGCCCAGGU |
| crLAG3_41 | CTTT | 221 | CUCCAUAGGUGCCCAACGCUC |
| crLAG3_42 | TTTC | 222 | UCCAUAGGUGCCCAACGCUCU |
| crLAG3_43 | TTTC | 223 | UCAUCCUUGGUGUCCUUUCUC |
| crLAG3_44 | CTTG | 224 | GUGUCCUUUCUCUGCUCCUUU |
| crLAG3_45 | CTTT | 225 | CUCUGCUCCUUUUGGUGACUG |
| crLAG3_46 | CTTC | 226 | UGCGAAGAGCAGGGGUCACUU |
| crLAG3_47 | CTTT | 227 | UGGUGACUGGAGCCUUUGGCU |
| crLAG3_48 | TTTT | 228 | GGUGACUGGAGCCUUUGGCUU |
| crLAG3_49 | CTTT | 229 | GGCUUUCACCUUUGGAGAAGA |
| crLAG3_50 | TTTG | 230 | GCUUUCACCUUUGGAGAAGAC |
| crLAG3_51 | CTTG | 231 | CUCUAAGGCAGAAAAUCGUCU |
| crLAG3_52 | TTTT | 232 | CUGCCUUAGAGCAAGGGAUUC |
| crLAG3_53 | CTTA | 233 | GAGCAAGGGAUUCACCCUCCG |
| crLAG3_54 | TTTC | 234 | CCGCCCAGUGGCCCGCCCGCU |
| crLAG3_55 | CTTC | 235 | UCGCUAUGGCUGCGCCCAGCC |
| crLAG3_56 | TTTA | 236 | UCCUUGCACAGUGACUGCCAG |
| crPDCD1_1 | TTTA | 237 | GCACGAAGCUCUCCGAUGUGU |
| crPDCD1_2 | TTTC | 238 | UCUGCAGGGACAAUAGGAGCC |
| crPDCD1_3 | TTTC | 239 | CAGUGGCGAGAGAAGACCCCG |
| crPDCD1_4 | TTTC | 240 | CUAGCGGAAUGGGCACCUCAU |
| crPDCD1_5 | CTTC | 241 | GUGCUAAACUGGUACCGCAUG |
| crPDCD1_6 | CTTC | 242 | AACCUGACCUGGGACAGUUUC |

TABLE 1-continued

Spacer sequences

| Name | PAM | SEQ ID NO | Spacer sequence |
|---|---|---|---|
| crPDCD1_7 | CTTG | 243 | UCCGUCUGGUUGCUGGGGCUC |
| crPDCD1_8 | CTTC | 244 | CCCGAGGACCGCAGCCAGCCC |
| crPDCD1_9 | CTTC | 245 | CGUGUCACACAACUGCCCAAC |
| crPDCD1_10 | CTTC | 246 | CACAUGAGCGUGGUCAGGGCC |
| crPDCD1_11 | CTTT | 247 | GAUCUGCGCCUUGGGGGCCAG |
| crPDCD1_12 | TTTG | 248 | AUCUGCGCCUUGGGGGCCAGG |
| crPDCD1_13 | CTTG | 249 | GGGGCCAGGGAGAUGGCCCCA |
| crPDCD1_14 | CTTT | 250 | GUGCCCUUCCAGAGAGAAGGG |
| crPDCD1_15 | TTTG | 251 | UGCCCUUCCAGAGAGAAGGGC |
| crPDCD1_16 | TTTC | 252 | CCUUCCGCUCACCUCCGCCUG |
| crPDCD1_17 | CTTC | 253 | CAGAGAGAAGGGCAGAAGUGC |
| crPDCD1_18 | CTTC | 254 | UGCCCUUCUCUCUGGAAGGGC |
| crPDCD1_19 | TTTG | 255 | GAACUGGCCGGCUGGCCUGGG |
| crPDCD1_20 | CTTT | 256 | CUCCUCAAAGAAGGAGGACCC |
| crPDCD1_21 | TTTC | 257 | UCCUCAAAGAAGGAGGACCCC |
| crPDCD1_22 | CTTC | 258 | UCUCGCCACUGGAAAUCCAGC |
| crPDCD1_23 | CTTT | 259 | CCUAGCGGAAUGGGCACCUCA |
| crPDCD1_24 | CTTC | 260 | CGCUCACCUCCGCCUGAGCAG |
| crPDCD1_25 | CTTG | 261 | GCCCCUCUGACCGGCUUCCUU |
| crPDCD1_26 | CTTC | 262 | UCCACUGCUCAGGCGGAGGUG |
| crPDCD1_27 | CTTC | 263 | UCCCCAGCCCUGCUCGUGGUG |
| crPDCD1_28 | CTTC | 264 | GGUCACCACGAGCAGGGCUGG |
| crPDCD1_29 | CTTC | 265 | ACCUGCAGCUUCUCCAACACA |
| crPDCD1_30 | CTTC | 266 | UCCAACACAUCGGAGAGCUUC |
| crPTPN1_1 | TTTA | 267 | CCUGACAGCGAAUCAUAACAU |
| crPTPN1_2 | TTTC | 268 | AUUCCAACUUACCUAACGGAA |
| crPTPN1_3 | TTTC | 269 | UGUGCGCACUGGUGAUGACAA |
| crPTPN11_4 | TTTC | 270 | CAAUCUGCUCACCUGCUUGAG |
| crPTPN11_5 | TTTC | 27 | UUCUAGUUGAUCAUACCAGGG |
| crPTPN11_6 | TTTA | 272 | AUAACUUACCUCAAAUUCUUC |
| crPTPN11_7 | CTTA | 273 | CCUAACGGAAAGUGUGAAGUC |
| crPTPN11_8 | TTTC | 274 | CAGACACUACAACAACAGGAG |
| crPTPN11_9 | TTTA | 275 | GGUGGUUUCAUGGACAUCUCU |
| crPTPN11_10 | TTTC | 276 | CCAGAGAGAUGUCCAUGAAAC |
| crPTPN6_1 | TTTC | 277 | UAUGACCUGUAUGGAGGGGAG |
| crPTPN6_2 | TTTG | 278 | CGACUCUGACAGAGCUGGUGG |
| crPTPN6_3 | TTTG | 279 | CAGAAGCAGGAGGUGAAGAAC |

TABLE 1-continued

Spacer sequences

| Name | PAM | SEQ ID NO | Spacer sequence |
|---|---|---|---|
| crPTPN6_4 | TTTG | 280 | ACUGCCCCCCACCCAGGCCUG |
| crPTPN6_5 | CTTA | 281 | UGGGCCCUACUCUGUGACCAA |
| crPTPN6_6 | TTTC | 282 | ACCGAGACCUCAGUGGGCUGG |
| crPTPN6_7 | CTTC | 283 | UCUAGGUGGUACCAUGGCCAC |
| crPTPN6_8 | CTTG | 284 | GCCUGCAGCAGCGUCUCUGCC |
| crPTPN6_9 | TTTC | 285 | UUGUGCGUGAGAGCCUCAGCC |
| crPTPN6_10 | CTTC | 286 | GUGCUUUCUGUGCUCAGUGAC |
| crPTPN6_11 | CTTG | 287 | GGCUGGUCACUGAGCACAGAA |
| crPTPN6_12 | CTTT | 288 | CUGUGCUCAGUGACCAGCCCA |
| crPTPN6_13 | TTTC | 289 | UGUGCUCAGUGACCAGCCCAA |
| crPTPN6_14 | CTTG | 290 | AUGUGGGUGACCCUGAGCGGG |
| crPTPN6_15 | CTTA | 291 | CCUCGCACAUGACCUUGAUGU |
| crPTPN6_16 | TTTG | 292 | GCUCCCCCCAGGGUGGACGCU |
| crPTPN6_17 | CTTG | 293 | AGCAGGGUCUCUGCAUCCAGC |
| crPTPN6_18 | TTTG | 294 | GAGACCUUCGACAGCCUCACG |
| crPTPN6_19 | CTTC | 295 | GACAGCCUCACGGACCUGGUG |
| crPTPN6_20 | TTTC | 296 | AAGAAGACGGGGAUUGAGGAG |
| crPTPN6_21 | CTTC | 297 | UUGUUCAGUUCCAACACUCGG |
| crPTPN6_22 | CTTG | 298 | GCUGUAUCCUCGGACUCCUGC |
| crPTPN6_23 | TTTC | 299 | CCCACCCACAUCUCAGAGUUU |
| crPTPN6_24 | CTTC | 300 | CAGACGCUGGUGCAAGUUCUU |
| crPTPN6_25 | CTTG | 301 | CACCAGCGUCUGGAAGGGCAG |
| crPTPN6_26 | CTTG | 302 | UUCUCUGGCCGCUGCCCUUCC |
| crPTPN6_27 | CTTG | 303 | AUGUAGUUGGCAUUGAUGUAG |
| crPTPN6_28 | CTTG | 304 | CGUCCAGAACCAGCUGCUAGG |
| crPTPN6_29 | CTTC | 305 | UGGCAGAUGGCGUGGCAGGAG |
| crPTPN6_30 | TTTC | 306 | UCCACCUCUCGGGUGGUCAUG |
| crPTPN6_31 | CTTT | 307 | CUCCACCUCUCGGGUGGUCAU |
| crPTPN6_32 | CTTT | 308 | CCAGAACAAAUGCGUCCCAUA |
| crPTPN6_33 | TTTC | 309 | CAGAACAAAUGCGUCCCAUAC |
| crPTPN6_34 | TTTG | 310 | UAUUCGGUUGUGUCAUGCUCC |
| crPTPN6_35 | CTTA | 311 | CAGGUCUCCCCGCUGGACAAU |
| crPTPN6_36 | CTTC | 312 | CUGGCUCGGCCCAGUCGCAAG |
| crPTPN6_37 | CTTA | 313 | GGGAGACCUGAUUCGGGAGAU |
| crPTPN6_38 | CTTC | 314 | CUGGACCAGAUCAACCAGCGG |
| crPTPN6_39 | TTTC | 315 | CUGCCGCUGGUUGAUCUGGUC |
| crPTPN6_40 | CTTT | 316 | CCUGCCGCUGGUUGAUCUGGU |
| crPTPN6_41 | CTTG | 317 | GUGGAGAUGUUCUCCAUGAGC |
| crPTPN6_42 | CTTG | 318 | UACUGCGCCUCCGUCUGCACC |
| crPTPN6_43 | TTTC | 319 | AAUGAACUGGGCGAUGGCCAC |
| crPTPN6_44 | CTTC | 320 | UUCUUAGUGGUUUCAAUGAAC |
| crPTPN6_45 | CTTC | 321 | UCCCCUCCAUACAGGUCAUAG |
| crPTPN6_46 | CTTG | 322 | GAGUCUAGUGCAGGGACCGUG |
| crPTPN6_47 | CTTG | 323 | CCCCCCUGCACCCGGCUGCAG |
| crPTPN6_48 | CTTG | 324 | UGUCUGCAGCCGGGUGCAGGG |
| crPTPN6_49 | TTTC | 325 | UCCUCCCUCUUGUUCUUAGUG |
| crPTPN6_50 | CTTT | 326 | CUCCUCCCUCUUGUUCUUAGU |
| crPTPN6_51 | CTTC | 327 | UUCACUUUCUCCUCCCUCUUG |
| crPTPN6_52 | CTTG | 328 | AGGUGGAUGAUGGUGCCGUCG |
| crPTPN6_53 | CTTC | 329 | CCUGACGCUGCCUUCUCUAGG |
| crTIGIT_1 | TTTC | 330 | AGGCCUUACCUGAGGCGAGGG |
| crTIGIT_2 | TTTT | 331 | GUCCUCCCUCUAGUGGCUGAG |
| crTIGIT_3 | CTTG | 332 | GGGUGGCACAUCUCCCCAUCC |
| crTIGIT_4 | TTTC | 333 | UGCAGAGAAAGGUGGCUCUAU |
| crTIGIT_5 | TTTG | 334 | UAAUGCUGACUUGGGGUGGCA |
| crTIGIT_6 | CTTA | 335 | CCUGAGGCGAGGGGAGCCUGC |
| crTIGIT_7 | CTTG | 336 | AAGGAUGGGGAGAUGUGCCAC |
| crTIGIT_8 | CTTC | 337 | AAGGAUCGAGUGGCCCCAGGU |
| crTIGIT_9 | CTTC | 338 | UGCAUCUAUCACACCUACCCU |
| crTIGIT_10 | TTTC | 339 | UAGGACCUCCAGGAAGAUUCU |
| crTIGIT_11 | CTTT | 340 | CUAGGACCUCCAGGAAGAUUC |
| crTIGIT_12 | CTTG | 341 | CUCCAGCAGGAAUACCUGAGC |
| crTIGIT_13 | CTTG | 342 | GAGCCAUGGCCGCGACGCUGG |
| crTIGIT_14 | TTTC | 343 | UAGUCAACGCGACCACCACGA |
| crTIGIT_15 | CTTT | 344 | CUAGUCAACGCGACCACCACG |
| crTIGIT_16 | TTTG | 345 | UAGUUUGUUUGUUUUUAGAAG |
| crTIGIT_17 | TTTG | 346 | UUUGUUUUUAGAAGAAAGCCC |
| crTIGIT_18 | TTTG | 347 | UUUUUAGAAGAAAGCCCUCAG |
| crTIGIT_19 | TTTT | 348 | UAGAAGAAAGCCCUCAGAAUC |
| crTIGIT_20 | CTTC | 349 | CACAGAAUGGAUUCUGAGGGC |
| crTIGIT_21 | TTTT | 350 | CUCCUGAGGUCACCUUCCACA |
| crTIGIT_22 | CTTC | 351 | CUGGGGGUGAGGGAGCACUGG |
| crTIGIT_23 | CTTC | 352 | UGCCUGGACACAGCUUCCUGG |
| crTIGIT_24 | CTTC | 353 | GUCCUCUUCCCUAGGAAUGAU |

TABLE 1-continued

Spacer sequences

| Name | PAM | SEQ ID NO | Spacer sequence |
|---|---|---|---|
| crTIGIT_25 | CTTC | 354 | UGUAACUCAGGACAUUGAAGU |
| crTIGIT_26 | CTTC | 355 | AAUGUCCUGAGUUACAGAAGC |
| crTIGIT_27 | TTTC | 356 | UAUUGUGCCUGUCAUCAUUCC |
| crTIGIT_28 | TTTC | 357 | UCUGCAGAAAUGUUCCCCGUU |
| crTIGIT_29 | CTTT | 358 | CUCUGCAGAAAUGUUCCCCGU |
| crTIGIT_30 | CTTG | 359 | UGCCGUGGUGGAGGAGAGGUG |
| crTIGIT_31 | CTTC | 360 | UGGCCAUUUGUAAUGCUGACU |
| crTIM3_1 | CTTA | 361 | CUUGUAAGUAGUAGCAGCAGC |
| crTIM3_2 | TTTC | 362 | CAAGGAUGCUUACCACCAGGG |
| crTIM3_3 | CTTG | 363 | UAAGUAGUAGCAGCAGCAGCA |
| crTIM3_4 | CTTA | 364 | CCACCAGGGGACAUGGCCCAG |
| crTIM3_5 | TTTG | 365 | AAUGUGGCAACGUGGUGCUCA |
| crTIM3_6 | CTTT | 366 | UCUUCUGCAAGCUCCAUGUUU |
| crTIM3_7 | CTTT | 367 | GCCCCAGCAGACGGGCACGAG |
| crTIM3_8 | TTTC | 368 | AUCAGUCCUGAGCACCACGUU |
| crTIM3_9 | CTTT | 369 | CAUCAGUCCUGAGCACCACGU |
| crTIM3_10 | TTTA | 370 | GCCAGUAUCUGGAUGUCCAAU |
| crTIM3_11 | TTTG | 371 | CGGAAAUCCCCAUUUAGCCAG |
| crTIM3_12 | CTTT | 372 | GCGGAAAUCCCCAUUUAGCCA |
| crTIM3_13 | TTTC | 373 | CGCAAAGGAGAUGUGUCCCUG |
| crTIM3_14 | TTTG | 374 | GAUCCGGCAGCAGUAGAUCCC |
| crTIM3_15 | TTTT | 375 | UCAUCAUUCAUUAUGCCUGGG |
| crTIM3_16 | TTTT | 376 | CUUCUGCAAGCUCCAUGUUUU |
| crTIM3_17 | CTTC | 377 | AGGUUAAAUUUUUCAUCAUUC |
| crTIM3_18 | TTTG | 378 | AUGACCAACUUCAGGUUAAAU |
| crTIM3_19 | TTTA | 379 | ACCUGAAGUUGGUCAUCAAAC |
| crTIM3_20 | CTTA | 380 | UGUUGUUUCUGACAUUAGCCA |
| crTIM3_21 | TTTC | 381 | UGACAUUAGCCAAGGUCACCC |
| crTIM3_22 | CTTG | 382 | GAAAGGCUGCAGUGAAGUCUC |
| crTIM3_23 | CTTC | 383 | ACUGCAGCCUUUCCAAGGAUG |
| crTIM3_24 | CTTT | 384 | CCAAGGAUGCUUACCACCAGG |
| crTIM3_25 | TTTT | 385 | CACAUCUUCCCUUUGACUGUG |
| crTIM3_26 | TTTT | 386 | UAUAGCAGAGACACAGACACU |
| crTIM3_27 | TTTA | 387 | UAUCAGGGAGGCUCCCCAGUG |
| crTIM3_28 | CTTA | 388 | CUGUUAGAUUUAUAUCAGGGA |
| crTIM3_29 | TTTG | 389 | UGUUUCCAUAGCAAAUAUCCA |
| crTIM3_30 | TTTC | 390 | CAUAGCAAAUAUCCACAUUGG |
| crTIM3_31 | CTTA | 391 | CGGGACUCUGGAGCAACCAUC |
| crTIM3_32 | TTTG | 392 | AAAAUUAAAGCGCCGAAGAUA |
| crTIM3_33 | CTTA | 393 | CAUUUGAAAAUUAAAGCGCCG |
| crTIM3_34 | CTTT | 394 | UGUUUCCCCCUUACUAGGGUA |
| crTIM3_35 | TTTT | 395 | GUUUCCCCCUUACUAGGGUAU |
| crTIM3_36 | CTTT | 396 | GACUGUGUCCUGCUGCUGCUG |
| crTIM3_37 | TTTC | 397 | CCCCUUACUAGGGUAUUCUCA |
| crTIM3_38 | CTTA | 398 | CUAGGGUAUUCUCAUAGCAAA |
| crTIM3_39 | CTTA | 399 | AAUUCUGUAUCUUCUCUUUGC |
| crTIM3_40 | CTTT | 400 | AUUUCCACAGCCUCAUCUCUU |
| crTIM3_41 | TTTA | 401 | UUUCCACAGCCUCAUCUCUUU |
| crTIM3_42 | TTTC | 402 | CACAGCCUCAUCUCUUUGGCC |
| crTIM3_43 | TTTG | 403 | GCCAACCUCCCUCCCUCAGGA |
| crTIM3_44 | TTTG | 404 | CCAAUCCUGAGGGAGGGAGGU |
| crTIM3_45 | TTTT | 405 | CUUCUGAGCGAAUUCCCUCUG |
| crTIM3_46 | CTTC | 406 | AUAUACGUUCUCUUCAAUGGU |
| crTIM3_47 | CTTT | 407 | GGGUUGUCGCUUUGCAAUGCC |
| crTIM3_48 | TTTG | 408 | GGUUGUCGCUUUGCAAUGCCA |
| crTIM3_49 | CTTC | 409 | UCUCUCUAUGCAGGGUCCUCA |
| crTIM3_50 | CTTC | 410 | UACACCCCAGCCGCCCCAGGG |
| crTIM3_51 | TTTG | 411 | CCCCAGCAGACGGGCACGAGG |
| crAAVS1 | TTTC | 412 | TTAGGATGGCCTTCTCCGACG |

Figure 2:
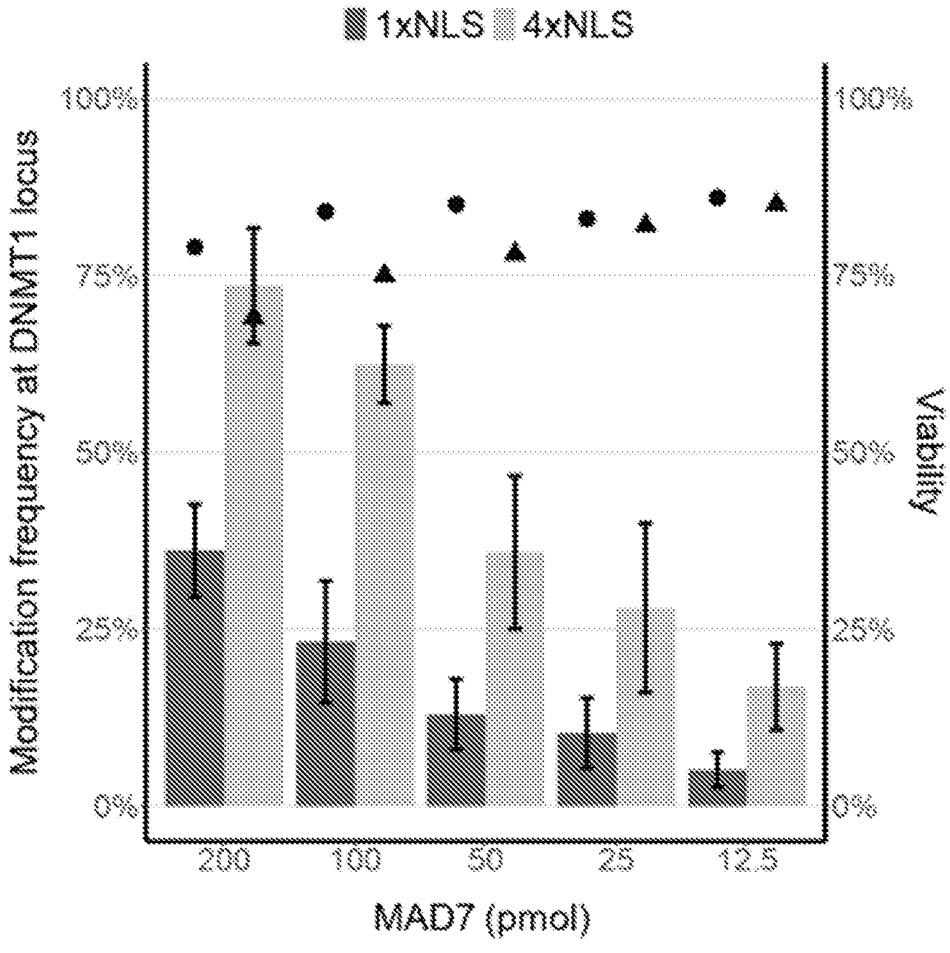
FIG. 2 shows editing frequency at the DNMT1 locus in and post-transfection cell viability of T-cell leukemic cells following treatment comprising one or more guide nucleic acids complexed with MAD7 comprising one or more NLS.

Firstly, using a gNA targeting the DNMT1 locus, the editing frequency of MAD7 comprising either one or four NLS complexed with the respective gNA was compared. RNP concentration-dependent modification efficiency was observed as evidenced by an increased fraction of modified amplicons (FIG. 2, left axis, dark grey for MAD7-1NLS and light grey representing MAD7-4NLS). Error bars represent one standard deviation for a sample of 3 (n=3). In this experiment, editing frequency was enhanced in Jurkat cells when treated with RNPs comprising MAD-4NLS, which indicates that optimization of the NLS can improve editing efficiency. A slight decrease in cell viability was seen at higher concentrations of RNP for those comprising four NLS as compared to one NLS (FIG. 2, right axis). Specifically, FIG. 2 shows editing frequency at the DNMT1 locus (n=3; Mean±SD) and cell viability of T-cell leukemic cells as a function of MAD7 comprising one or four nuclear localization signal (NLS) and MAD7-RNP amounts (pmol; constant ratio of 1:1.5 MAD7:gNA). Dark grey bars and circles represent mean modification frequency and viability using MAD7-1NLS, respectively. Light grey bars and triangles represent mean modification frequency and viability using MAD7-4NLS, respectively.

Figure 3:
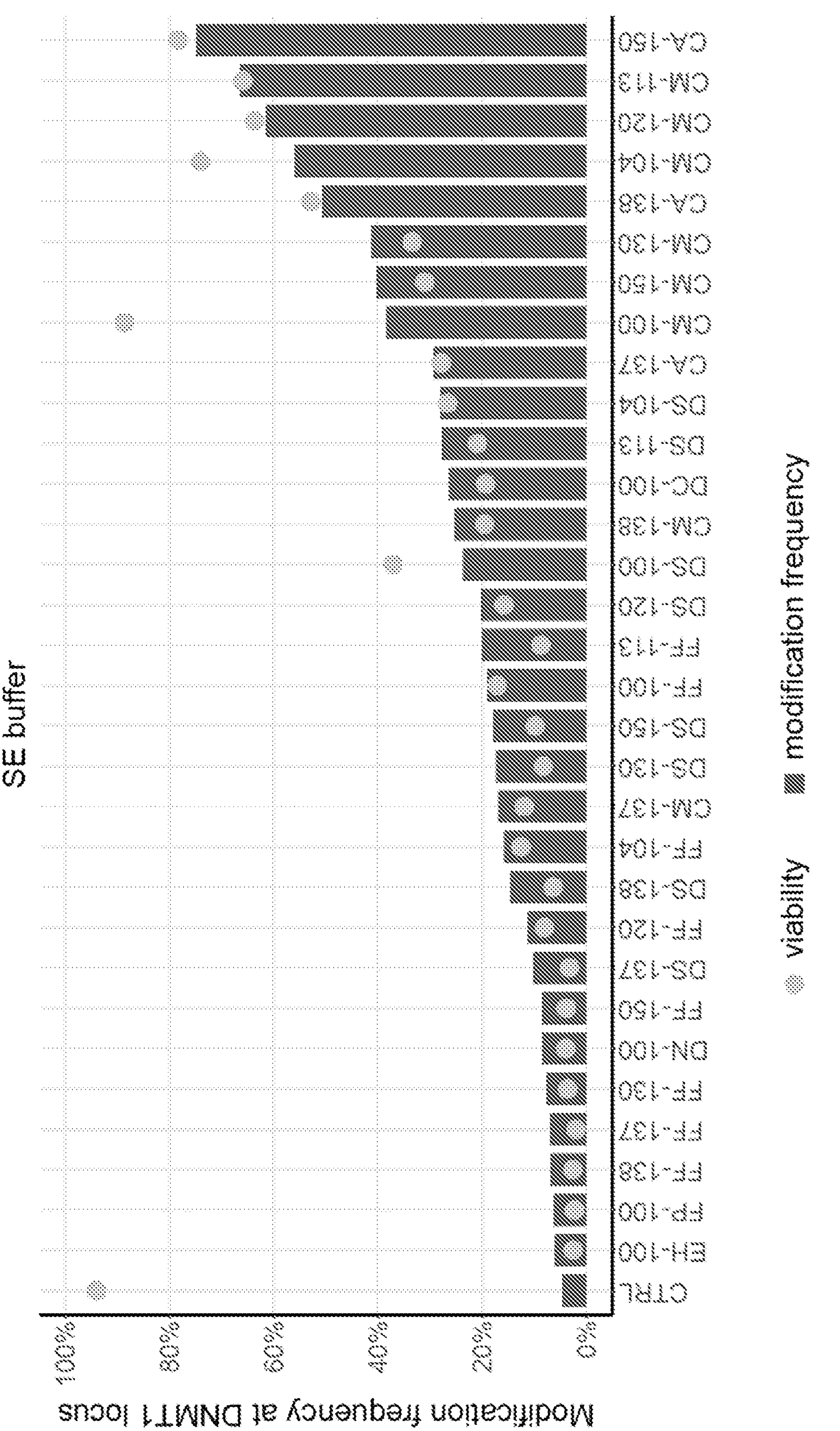
FIG. 3 shows editing frequency at the DNMT1 locus in T-cell leukemic cells using multiple electroporation programs in combination with the SE electroporation buffer.
Figure 4:
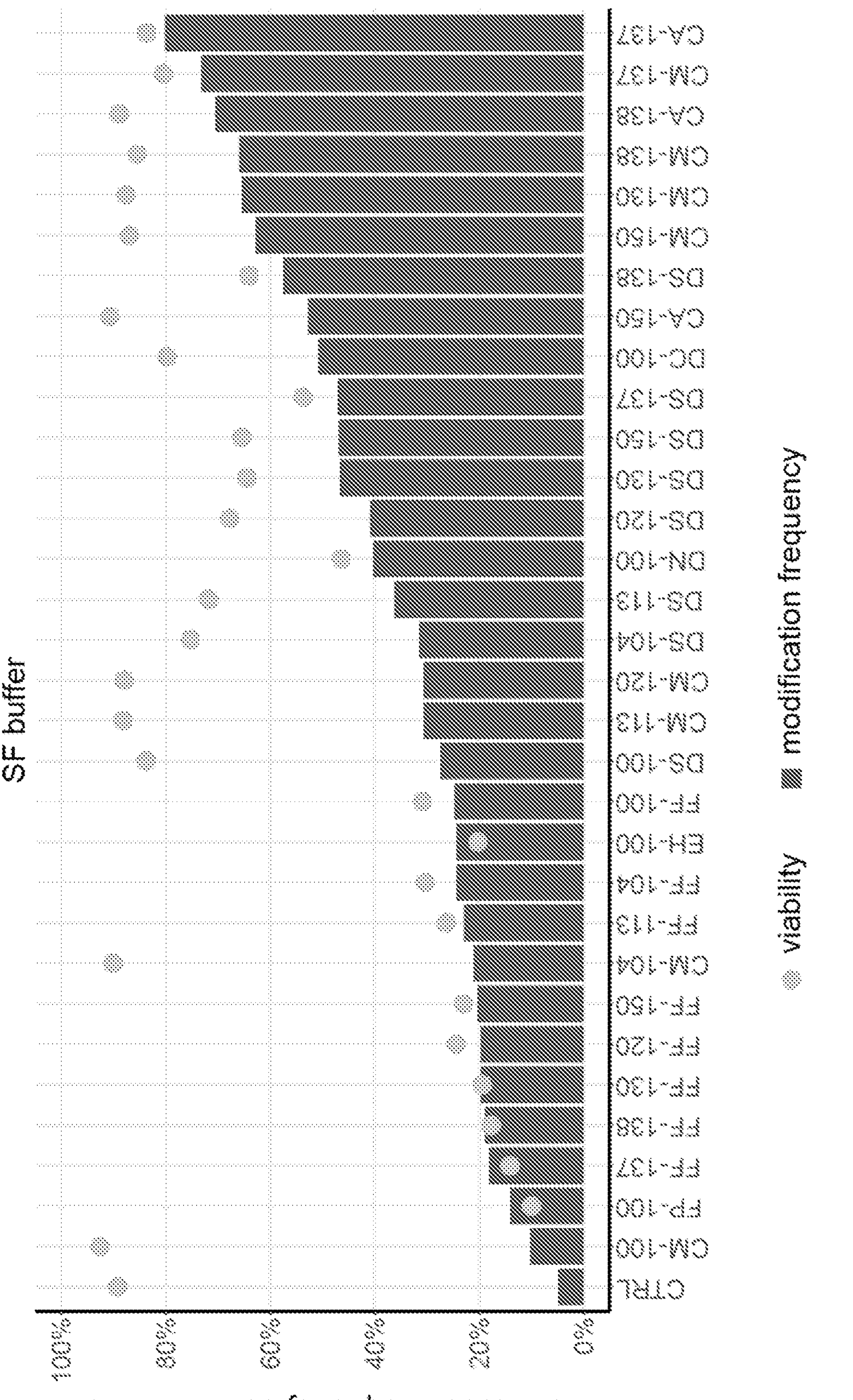
FIG. 4 shows editing frequency at the DNMT1 locus in T-cell leukemic cells using multiple electroporation programs in combination with the SF electroporation buffer.
Figure 5:
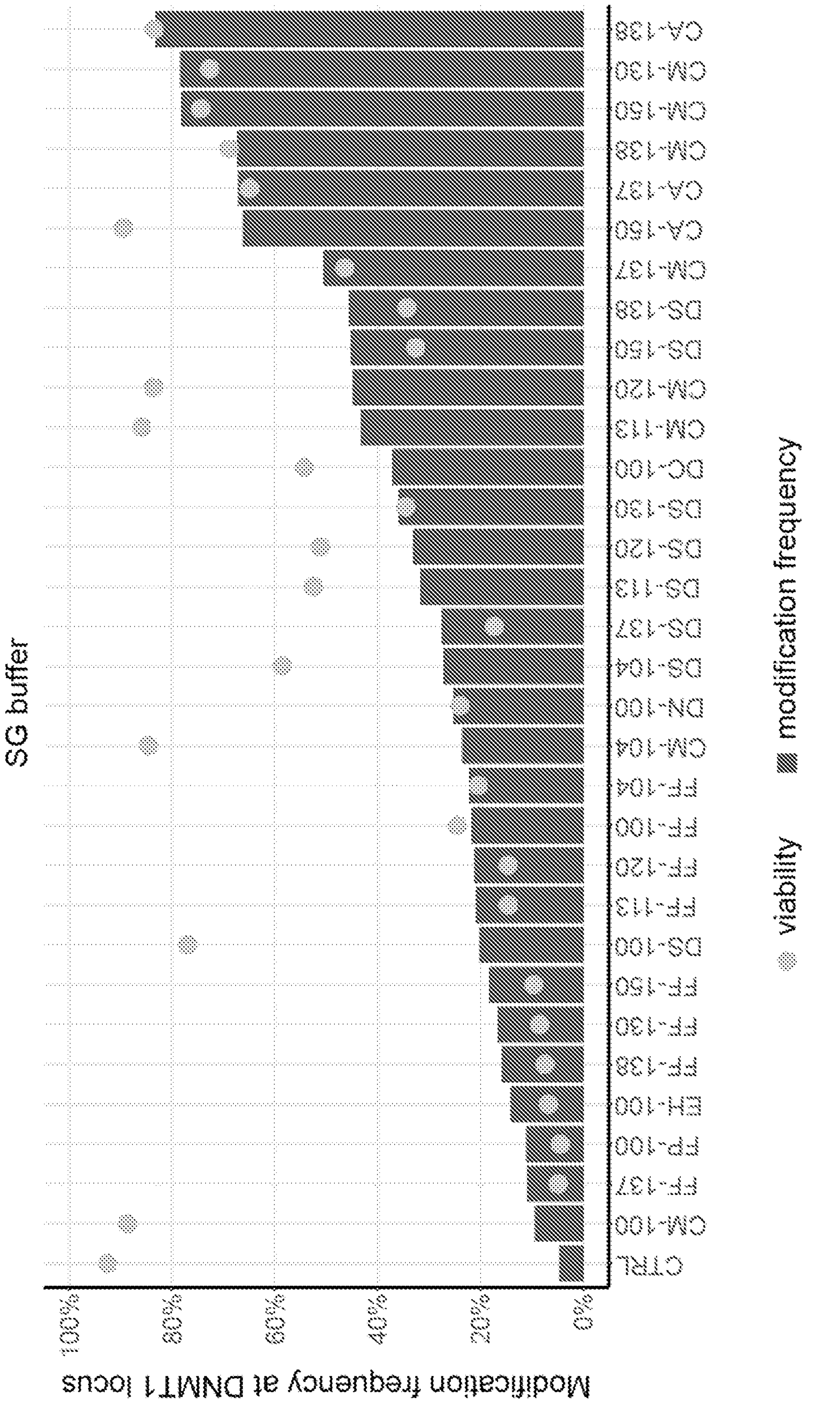
FIG. 5 shows editing frequency at the DNMT1 locus in T-cell leukemic cells using multiple electroporation programs in combination with the SG electroporation buffer.
Figure 6:
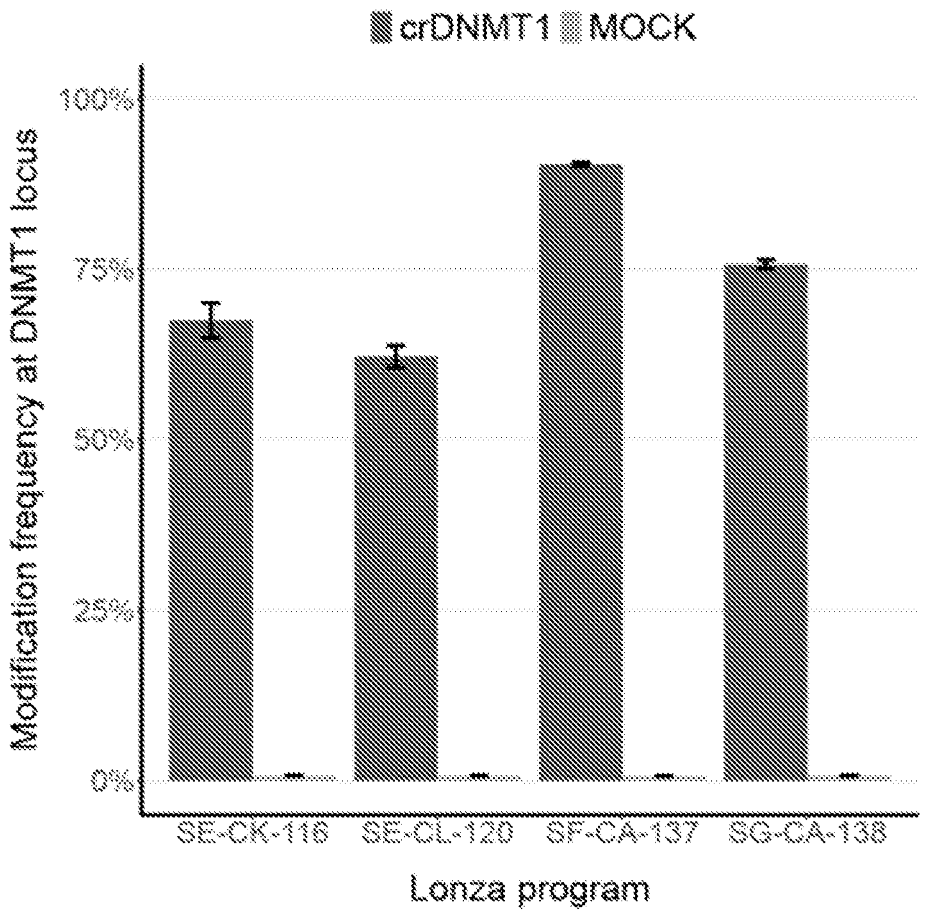
FIG. 6 shows editing frequency at the DNMT1 locus in T-cell leukemic cells using multiple electroporation programs.

To optimize editing activity, 93 different transfection conditions were tested; 31 nucleofection programs in combination with three buffers-on the Lonza Nucleofector 96-well Shuttle System (FIGS. 3-5). FIGS. 3, 4, and 5 show the editing frequency (bars; x-axis) of each of the electroporation conditions (buffers SE, SF, and SG respectively) as compared to a control (y-axis, control at the top). The majority of buffer-program transfection combinations resulted in suboptimal viability (dots; x-axis) and editing frequency, however, the analysis revealed several conditions that supported substantial rates of both cell viability and editing. Two improved conditions observed in the screen, namely SF-CA-137 and SG-CA-138, were then validated and compared to the Lonza recommended nucleofection programs for T-cell leukemia, namely SE-CL-120 and SE-CK-116 (FIG. 6). Specifically, FIG. 6 shows editing frequency at the DNMT1 locus (n=4; Mean±SD) in T-cell leukemic cell line achieved by utilization of the transfection conditions identified in FIG. 2 (100 pmol MAD7-4NLS) and Lonza recommended nucleofection programs SE-CK-116 and SE-CL-120, as well as the two best nucleofection programs observed in this study, SF-CA-137 and SG-CA-138 (FIGS. 3-5). Dark grey bars represent mean modification frequency using crDNMT1. Light grey bars represent mean modification frequency using crIDTneg (Integrated DNA Technologies, IDT).

Example 12: Scalable High-Level MAD7-RNP Editing of Immunologically Relevant Genes in Jurkate T-Cell Leukemia Cell Line The Jurkat T-cell leukemia cell line was used as a model system to screen GNAs demonstrating high editing efficiency. The screen included 298 unique gNAs comprising one or more spacer sequences of SEQ ID NOs: 86-384 of Table 1 targeting the immune checkpoint receptors PDCD1, TIM3, LAG3, TIGIT, and CTLA4, the checkpoint phosphatases PTPN6 (SHP-1) and PTPN11 (SHP-2), and the TCR signaling subunit CD247 (CD3ζ). RNPs were generated as described in Example 3, nucleofected (Example 5), genomic DNA was extracted (Example 8), the edited loci amplified and sequenced (Example 9), and the sequencing data computationally analyzed (Example 10) using the CRISPResso2 algorithm.

Figure 7:
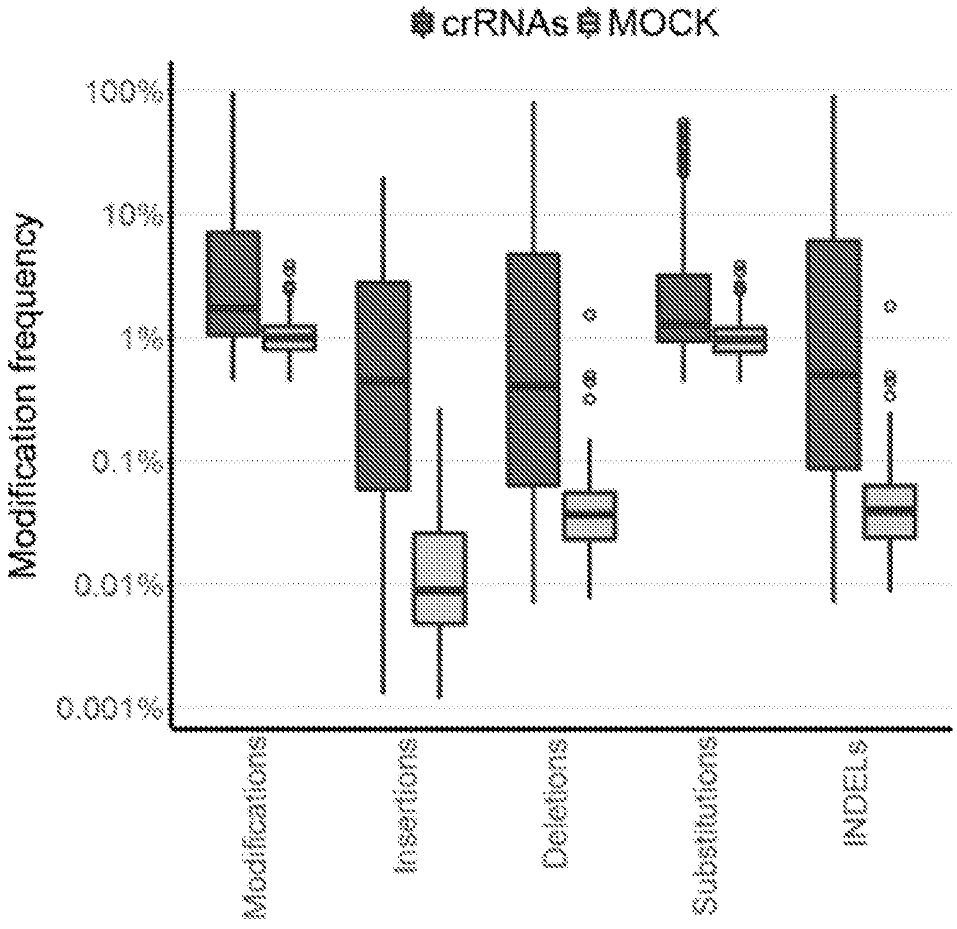
FIG. 7 shows editing frequency by type at eight loci in T-cell leukemic cells using multiple guide nucleic acids complexed with MAD7 comprising one or more NLS.
Figure 8:
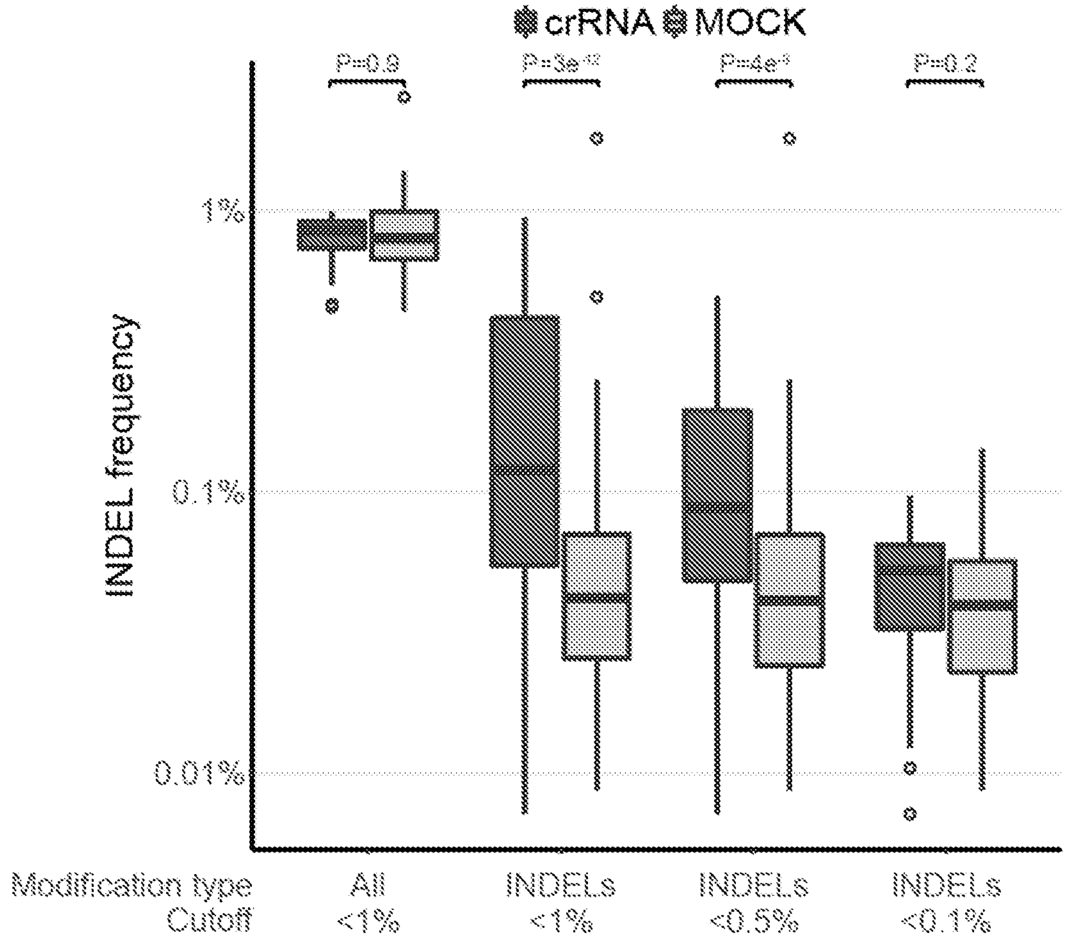
FIG. 8 shows a comparison of editing efficiency between T-cell leukemic cells treated with MAD7 comprising one or more guide nucleic acids targeting the DNMT1 locus as compared to a control guide nucleic acid binned by editing frequency.

CRISPResso2 software reports the frequency of modifications (insertions, deletions, and substitutions) within a quantification window flanking the position of MAD7-induced cleavage in the amplicon sequence. To better understand detection of editing events, the type of modifications detected in 230 amplicons that were sequenced in both gNA-treated and MOCK samples (no MAD7) were compared. Relatively high modification frequencies (median 1%) in MOCK reactions were observed as a result of high frequency of substitutions (FIG. 7, light grey bars); substitutions were detected at a median frequency of 0.96%, likely due to the errors in NGS base calling or substitutions arising during DNA amplification, while insertions and deletions were found at a much lower median frequency of 0.003% and 0.042%, respectively. Specifically, FIG. 7 shows editing frequency at eight different loci using 298 gNAs (n=3; Mean±SD) in T-cell leukemic cell line as a function of various editing types: all modifications, only insertions, only deletions, only substitutions, or insertions and deletions (INDELs). Edits were achieved using the transfection conditions identified in Example 11, FIG. 2 (100 pmol MAD7-4NLS) and one of the tested Lonza nucleofection programs (FIG. 6; SF-CA-137). Dark grey boxplots represent mean modification frequency using gNAs. Light grey boxplots represent mean modification frequency using crIDTneg (IDT). Thus, the frequency of both insertions and deletions (INDEL) were used as a means to quantify the editing activity of the CRISPR-MAD7 system to minimize low end noise. Moreover, low INDEL frequencies in MOCK reactions enabled sensitive detection of editing events at a significantly greater fraction of sites (Fisher exact test, $P=3\times10^{-12}$; FIG. 8). Analysis of gNAs with low INDEL frequencies showed statistically significant editing in gNA-treated samples compared to MOCK samples at INDEL frequencies as low as 0.5% (Fisher exact test, $P=4\times10^{-8}$; FIG. 8). This indicates the sensitivity of the assay to detect modifications in the sub-1% range. Specifically, FIG. 8 shows INDEL frequency at eight different loci using 298 gNAs (n=3; Mean±SD) in T-cell leukemic cell line as a function of two modification types: all modifications<1%, and INDELs<1%, or <0.5%, or <0.1%, with lower INDEL frequencies in MOCK compared to gNA reactions at INDELs<1% (Fisher's exact test; $P=3\times10^{-12}$) and <0.5% (Fisher exact test, $P=4\times10^{-8}$). Dark grey boxplots represent mean INDEL frequency using gNAs. Light grey boxplots represent mean INDEL frequency using crIDTneg (IDT).

Figure 9:
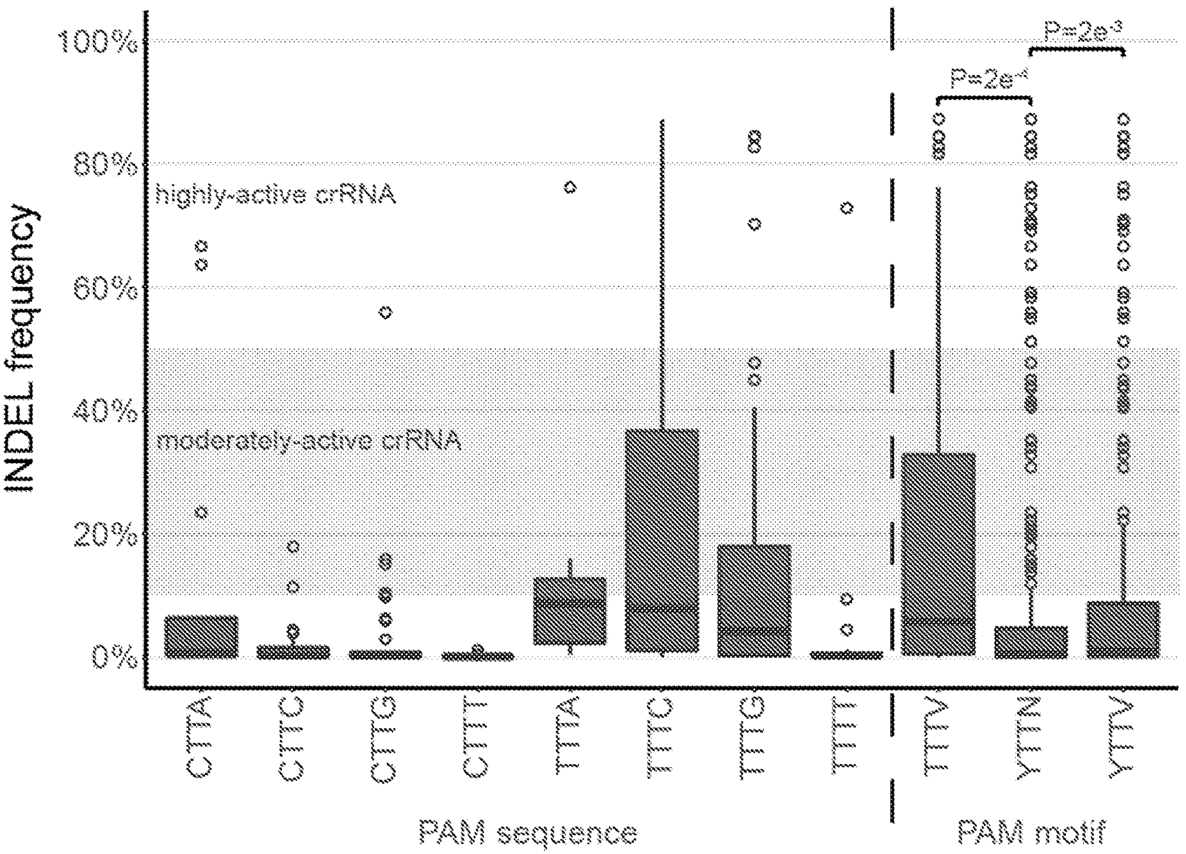
FIG. 9 shows editing frequency by PAM motif in T-cell leukemic cells using multiple guide nucleic acids complexed with MAD7 comprising one or more NLS.

Since MAD7 can target a wide range of PAM, gNAs adjacent to all YTTN PAM variants were screened and editing specificity of MAD7 in Jurkat cells was analyzed. MAD7 demonstrated editing with all eight combinations of YTTN PAM; in this experiment, editing was higher at the YTTV and TTTV consensus sequences (Fisher exact test; $P=2\times10^{-3}$ and $P=2\times10^{-4}$ respectively). While the majority of highly-active (>50% INDEL frequency) gNAs were found at sites with YTTV and TTTV PAMs, moderately-active (>10% INDEL frequency) gNAs were found to target every PAM sequence with the exception of CTTT. This indicates that MAD7 can edit a wide range of target PAMs, albeit at reduced frequencies (FIG. 9). Specifically, FIG. 9 shows INDEL frequency at eight different loci using 298 gNAs (n=3; Mean±SD) in T-cell leukemic cell line as a function of eight YTTN PAM combinations, and TTTV, YTTN, and YTTV PAM motifs. A grey zone on the plot represents moderately-active gNAs (10-50% INDELs), the zone above highly-active gNAs (>50% INDELs), and the zone below active gNAs (1-10% INDELs). INDEL frequency at the YTTV and TTTV PAM motif is significantly higher compared to YTTN motif (Fisher exact test, $P=2\times10^{-3}$ and $P=2\times10^{-4}$, respectively).

Figures 10A, 10B:
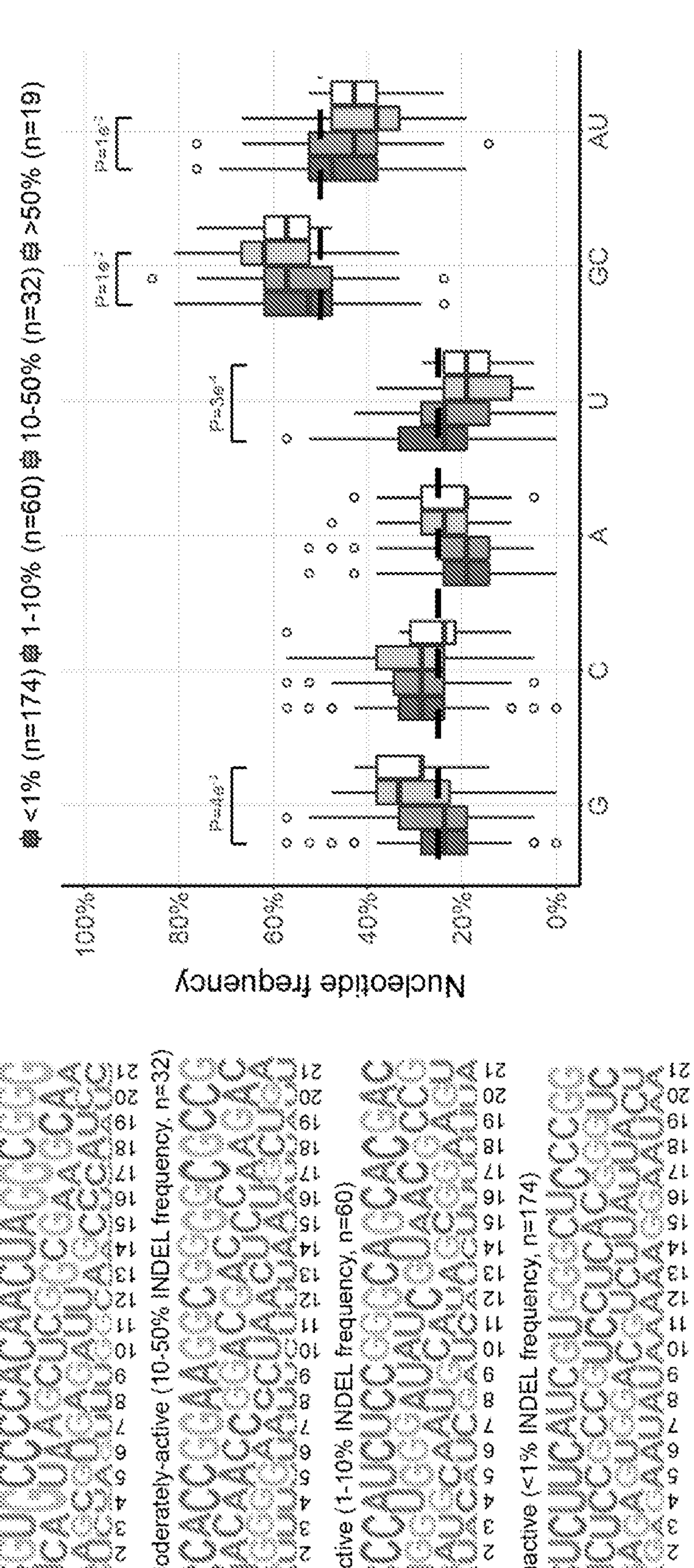
FIG. 10A shows sequence logo plots for multiple guide nucleic acids binned by editing frequency in T-cell leukemic cells using when complexed with MAD7 comprising one or more NLS.
FIG. 10B shows nucleotide and dinucleotide frequency for multiple guide nucleic acids binned by editing frequency in T-cell leukemic cells using when complexed with MAD7 comprising one or more NLS.
Figure 11:
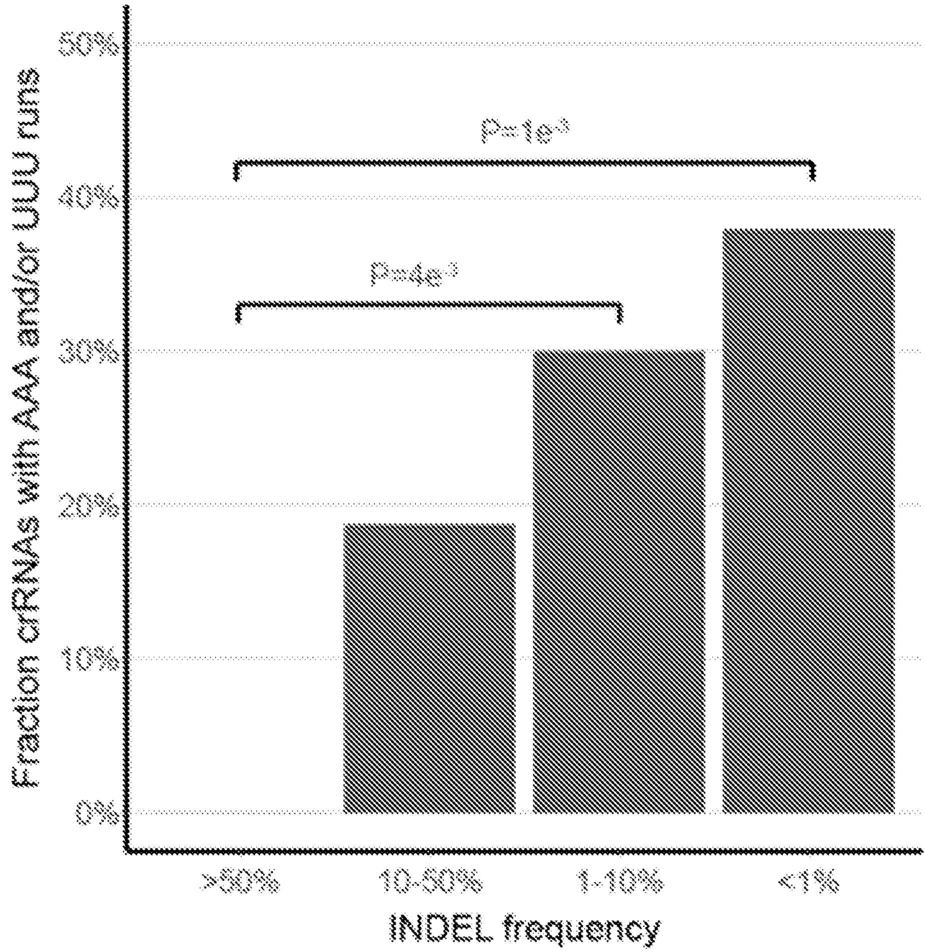
FIG. 11 shows trinucleotide AAA or UUU frequency binned by editing frequency in T-cell leukemic cells following treatment with multiple guide nucleic acids complexed with MAD7 comprising one or more NLS.

Given the large number of gNAs analyzed, it was determined if the targeted DNA sequence biases editing efficiency. Sequence logos were made to compare the DNA-complementary gNA sequences of inactive (<1% INDELs), active (1-10% INDELs), moderately-active (10-50% INDELs), and highly-active (>50% INDELs) gNAs (FIG. 10A). While no strong biases for ribonucleotides at specific positions were identified in this experiment, guanine appeared overrepresented and uracil underrepresented on moderately-active and highly-active gNAs. Next, the frequency of ribonucleotide bases were analyzed within the same four classes of gNAs (FIG. 10B). The analysis confirmed significant enrichment of guanine and depletion of uracil on highly-active gNAs. Specifically, FIG. 10 shows (A) sequence logos comparing DNA-complementary gNA sequences of highly-active (>50% INDELs), moderately-active (10-50% INDELs), active (1-10% INDELs), and inactive (<1% INDELs) gNAs show no strong biases for ribonucleotides at specific positions, however, guanine appeared overrepresented and uracil underrepresented on highly-active and moderately-active gNAs; (B) nucleotide frequency on inactive (<1% INDELs; dark grey box), active (1-10% INDELs; medium grey box), moderately-active (10-50% INDELs; light grey box), and highly-active (>50% INDELs; white box) gNAs, with significant enrichment of guanine and depletion of uracil on highly-active gNAs compared to inactive gNAs (Fisher exact test, $P=4\times10^{-3}$ and $P=3\times10^{-4}$, respectively). Also, significant enrichment of guanine-cytosine content and depletion of adenine-uracil content was observed on moderately-active gNAs compared to inactive gNAs (Fisher exact test, $P=1\times10^{-2}$). Moreover, the data showed that nearly 40% of inactive gNAs had runs of three or more adenine or uracil ribonucleotides, while none of the highly-active and <20% of moderately-active gNAs contained such runs (FIG. 11). These sequence features can act as an algorithm for selecting putative high-activity gNAs during initial rounds of screening, and could reduce the overall cost of identifying gNAs for various genes of interest. Specifically, FIG. 11 shows fraction of gNAs with AAA and/or UUU runs as a function of INDEL frequency of highly-active (>50% INDELs), moderately-active (10-50% INDELs), active (1-10% INDELs), and inactive (<1% INDELs) gNAs. Fraction of inactive (<1% INDELs) and active (1-10% INDELs) gNAs containing such runs is higher compared to highly-active (>50% INDELs) gNAs (Fisher exact test, $P=1\times10^{-3}$ and $P=4\times10^{-4}$, respectively).

Figure 12:
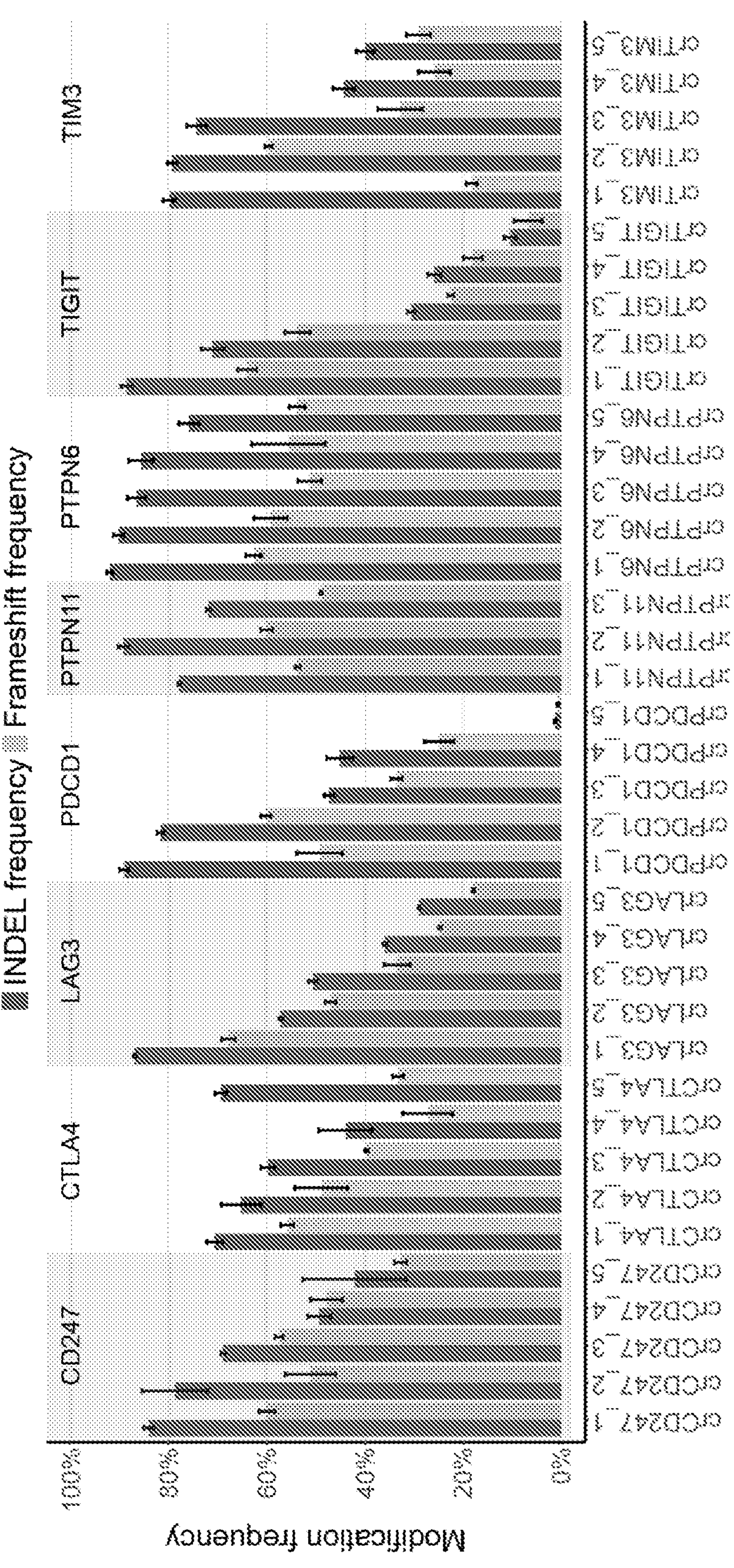
FIG. 12 shows editing frequency for both INDELs and frameshift mutations at eight loci in T-cell leukemic cells following treatment with multiple guide nucleic acids complexed with MAD7 comprising one or more NLS.
Figure 13:
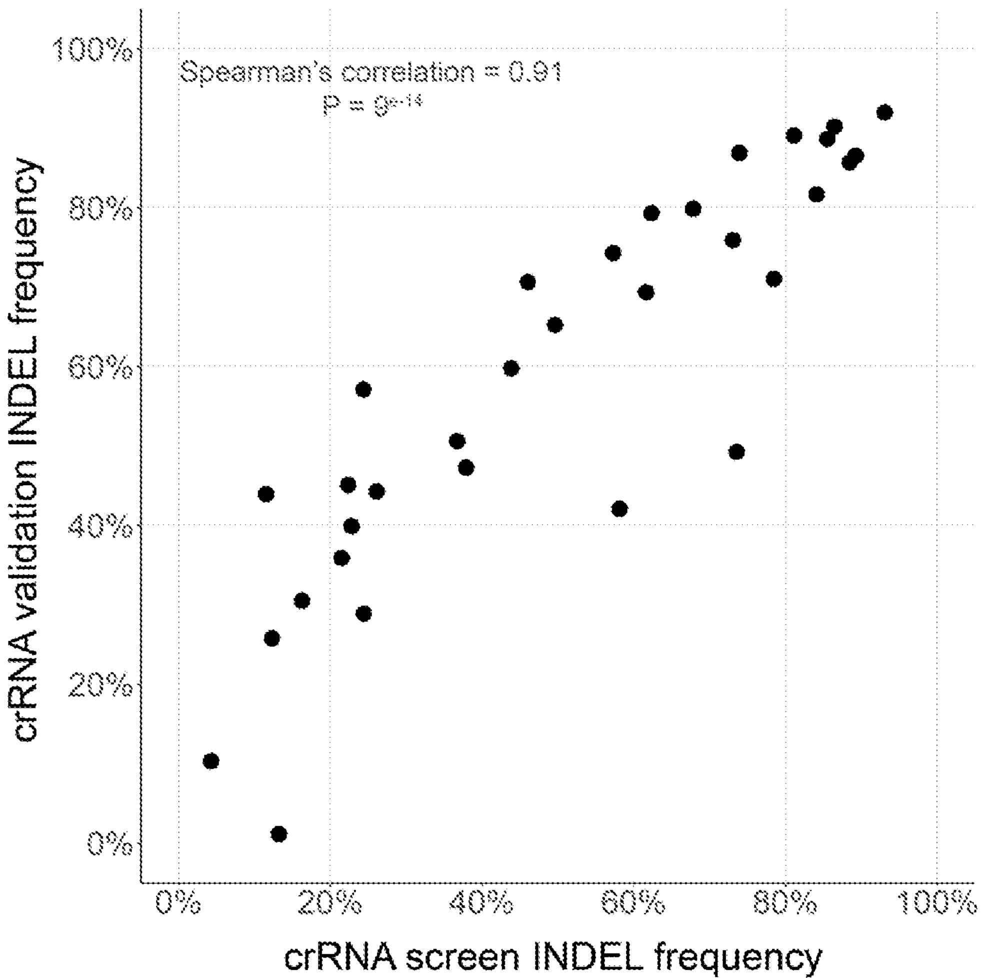
FIG. 13 shows the correlation between INDEL frequency in the gNA validation experiment versus INDEL formation in the gNA screen experiment.
Figure 14:
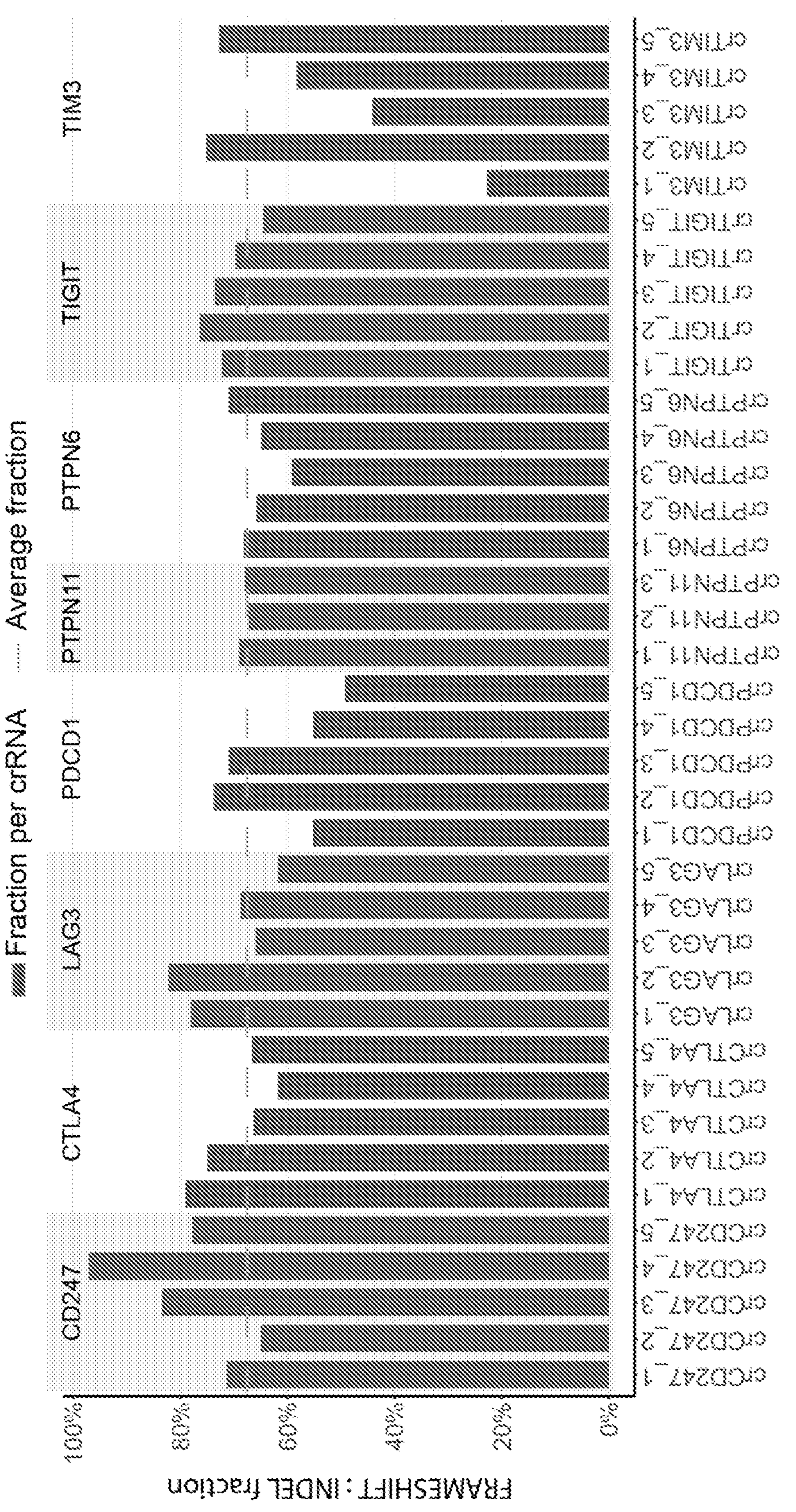
FIG. 14 shows the proportion of frameshift to INDELs at eight loci in T-cell leukemic cells following treatment with multiple guide nucleic acids complexed with MAD7 comprising one or more NLS.

Example 13: Validation of gNAs for Gene Editing and Disruption of Immunologically Relevant Genes Using T-Cell Leukemia Line High-efficiency gNAs identified in our initial analysis were validated by assaying INDEL frequency for the top three or five gNAs for each of the selected immunologically relevant genes (FIG. 12). Specifically, FIG. 12 shows INDEL (dark grey bars) and frameshift (light grey bars) frequencies (n=3; Mean±SD) in T-cell leukemic cell line as a function of 38 high-efficiency gNAs. Alternating grey and white zones on the plot represent groups of three to five high-efficiency gNAs per locus. In the validation experiment, the INDEL frequency was significantly correlated to the measurements from the initial screen, highlighting the reproducibility of the INDEL assay (FIG. 13). Specifically, FIG. 13 shows correlation of INDEL frequency in the gNA validation experiment versus INDEL formation in the gNA screen experiment (Spearman's correlation=0.91; $P=9\times10^{-14}$), highlighting reproducibility of the INDEL assay. Using the CRISPresso2 software, the degree of open reading frame (ORF) disruption for each of the validated gNAs was estimated (FIG. 12). In addition, for four high-efficiency gNAs targeting three different exons at the PDCD1 locus, surface expression of the PDCD1 protein was measured by flow cytometry 4, 7, and 11 days post-transfection (data not shown). The data revealed that the protein surface expression after transfection with crPDCD1_2, a gNA targeting the PDCD1 gene at the extracellular domain of the protein, was as low as 10% 4 days post-transfection and remained at this level even at day 11 post-transfection. The surface expression after transfection with the remaining three gNAs was significantly higher, 35% and 85% after transfection with crPDCD1_3 and both crPDCD1_4 and crPDCD1_5, respectively. This is in line with the ORF data analysis, which showed that for most of the gNAs including the high-efficiency crPDCD1s, the predicted number of INDELs leading to frameshifts was similar to that expected from an unbiased DNA repair process, with frameshifts in two-thirds of the edited loci (FIG. 14). However, several of the gNAs had a markedly different degree of ORF disruption; crCD247_4 resulted in frameshifts with 97% frequency, while crTIM3_1 and crTIM3_3 resulted in frameshifts with 23% and 44% frequency, respectively (FIG. 14). Specifically, FIG. 14 shows fraction of frameshift to INDEL frequency (dark grey bars) in T-cell leukemic cell line as a function of 38 high-efficiency gNAs. Average fraction of INDELs leading to frameshifts (dashed line) is approx. 66%. Alternating grey and white zones on the plot represent groups of three to five high-efficiency gNAs per locus. The analysis of repair products indicates that in the case of crTIM3_1, and to some extent crTIM3_3, the bias arose from directly repeated sequences at the DNA cleavage site, which possibly promoted microhomology-mediated end joining (MMEJ) repair following DNA cleavage. These data help inform selection of gNAs for gene KO since some gNAs, such as crTIM3_1, have much lower frequency of gene disruption than would be predicted based on the frequency of INDEL formation.

Figure 15:
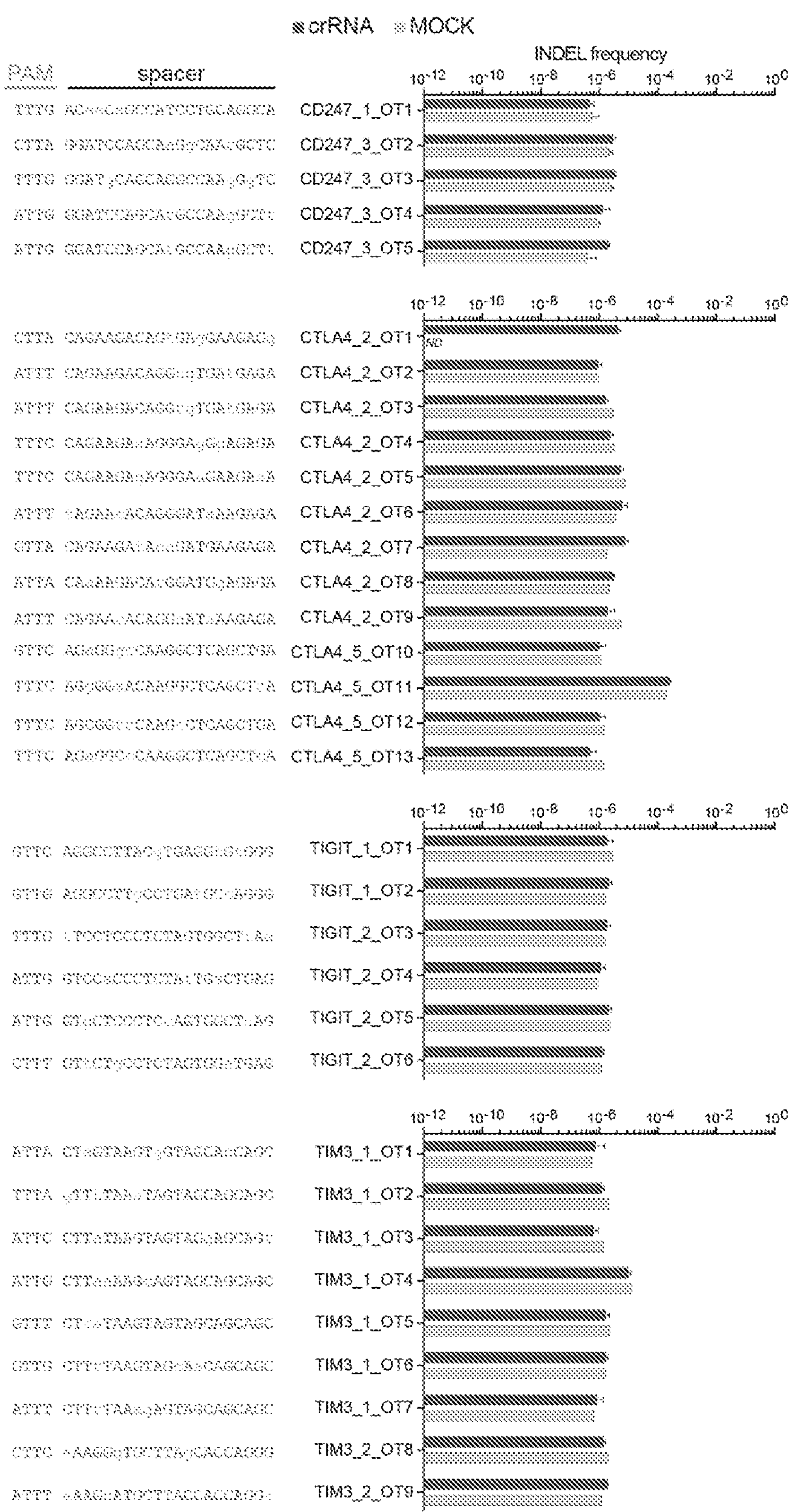
FIG. 15 shows INDEL frequency for gNAs comprising representative spacer sequences complexed with MAD7 comprising one or more NLS in T-cell leukemic cells at predicted off-target sites.
Figure 16:
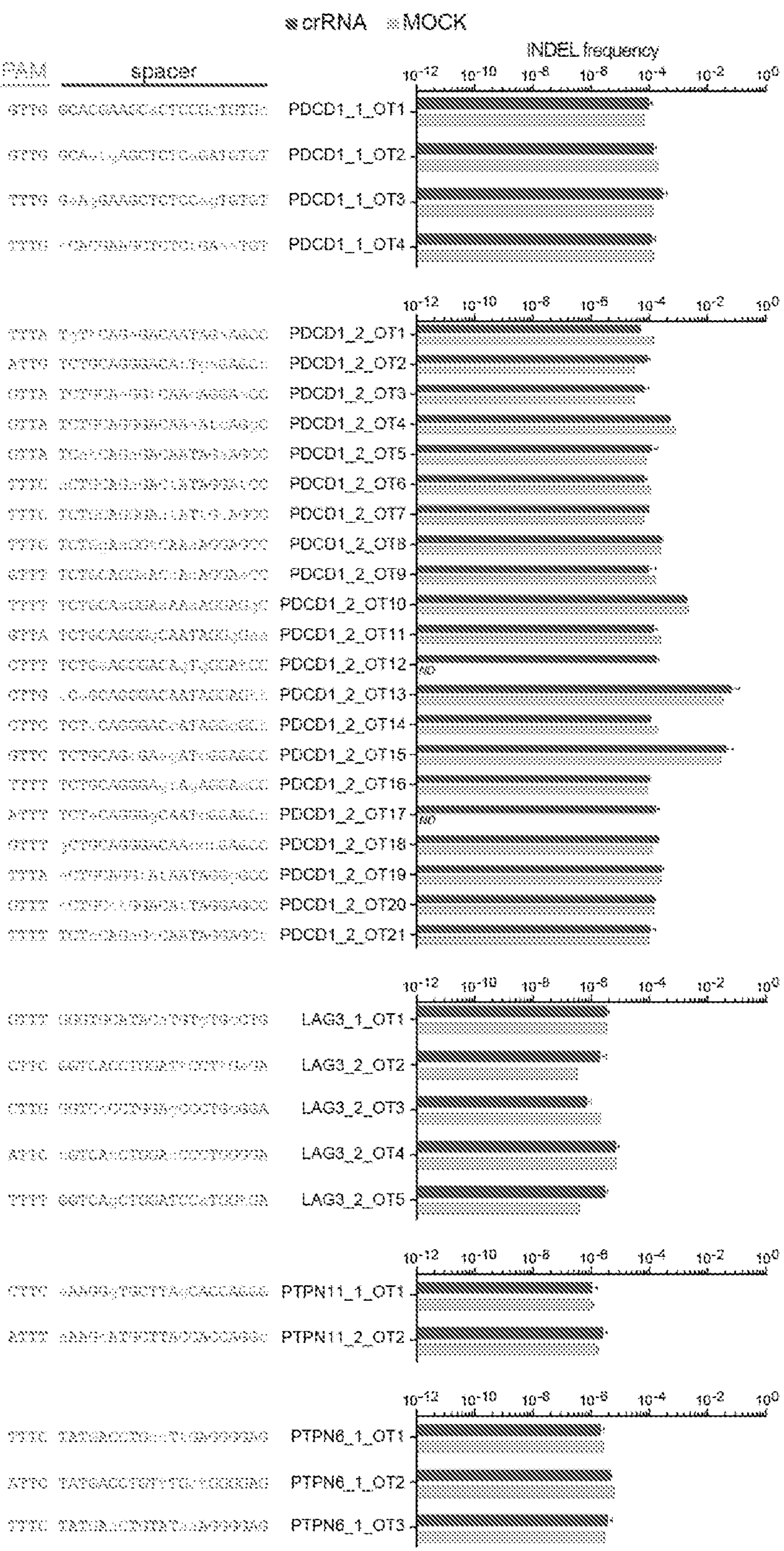
FIG. 16 shows INDEL frequency for gNAs comprising representative spacer sequences complexed with MAD7 comprising one or more NLS in T-cell leukemic cells at predicted off-target sites.

Another consideration for selecting gNAs is the potential for off-target cleavage events. The list of validated gNAs was analyzed using the CasOFFinder software to predict potential off-target editing sites in the genome with up to four mismatches between the gNA and the target DNA sequence. Using the Bioconductor R packages, the predicted off-target sites were matched with the human gene database, and those sites that targeted exons and introns within the genes were extracted. Afterwards, the degree of editing activity at these sites was examined by targeted next-generation sequencing, more specifically, at 25 predicted off-target sites for the top-two PDCD1 gNAs, i.e., crPDCD1_1 and crPDCD1_2. The analysis revealed low-level off-target activity at crPDCD1_2_13 and crPDCD1_2_15 sites, however, INDEL formation at these two sites was statistically insignificant compared to MOCK samples (non-targeting gNAs) (Pairwise T-test, $P\geq0.05$; FIGS. 15 and 16). INDEL frequency at 43 putative off-target sites with up to three mismatches between gNA and target DNA sequence were assayed for the top-two gNAs targeting seven remaining genes (i.e., TIM3, LAG3, TIGIT, CTLA4, PTPN6, PTPN11, and CD247; spacer sequences in Table 1). The analysis revealed no detectable activity at any of the putative off-target sites (FIGS. 15 and 16), which confirms the high cleavage fidelity of MAD7-gNA complexes. Specifically, FIGS. 15-16 show INDEL frequency of MAD7 (n=3; Mean±SD) in T-cell leukemic cell line at predicted off-target sites analyzed by targeted deep sequencing. For crPDCD1, INDEL frequency was analyzed at the putative off-target editing sites with ≤4 mismatches between the gNA and target DNA sequence, and with ≤3 mismatches on the remaining gNAs. PAM sequences and spacer sequences with mismatches marked in red are displayed next to their respective measured INDEL frequencies. No significant INDEL frequency at any of the off-target sites was detected (Pairwise T-test, $P\geq0.05$).

Insertion of exogenous transgenes is an important aspect of mammalian cell engineering. Gene insertion with CRISPR-Cas is achieved by homology-directed repair of CRISPR-induced DNA breaks using HDR-donor templates to copy exogenous genetic sequences into targeted DNA loci. Several studies indicate that HDR templates, composed of linear double stranded DNA, provide the most robust and efficient method of transgene insertion using CRISPR-Cas genome editing systems.

Figure 17:
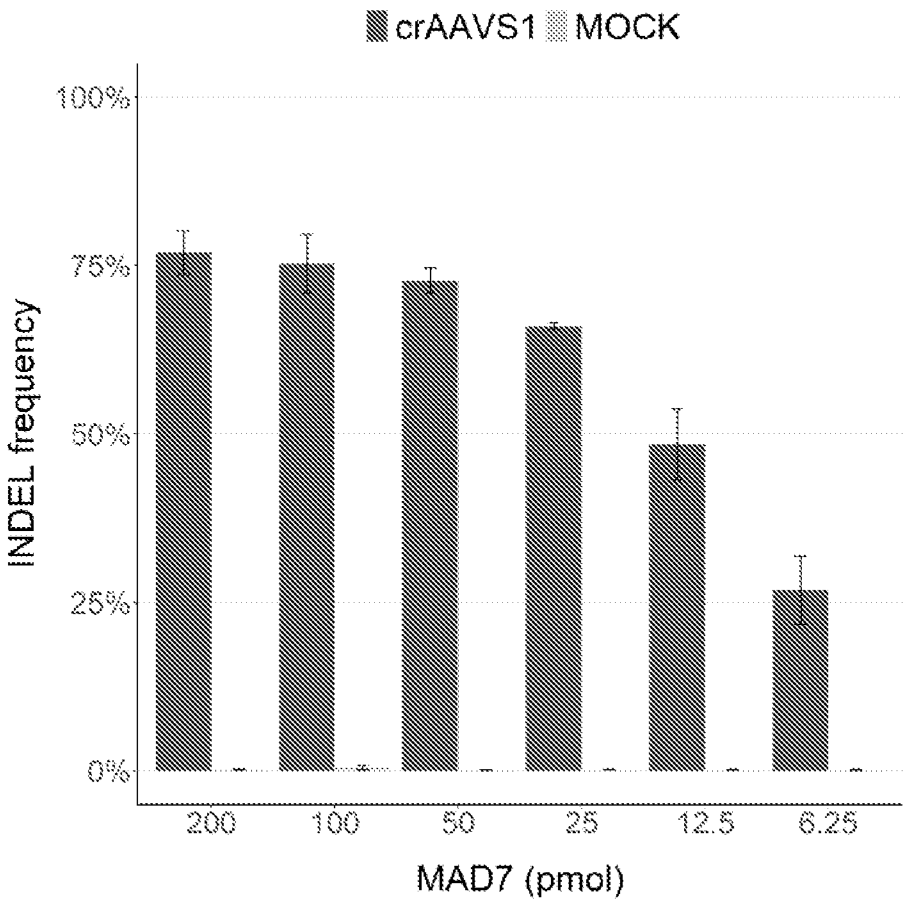
FIG. 17 shows INDEL frequency at the AAVS1 locus in T-cell leukemic cells following treatment with a gNA: MAD7 complex.
Figure 18:
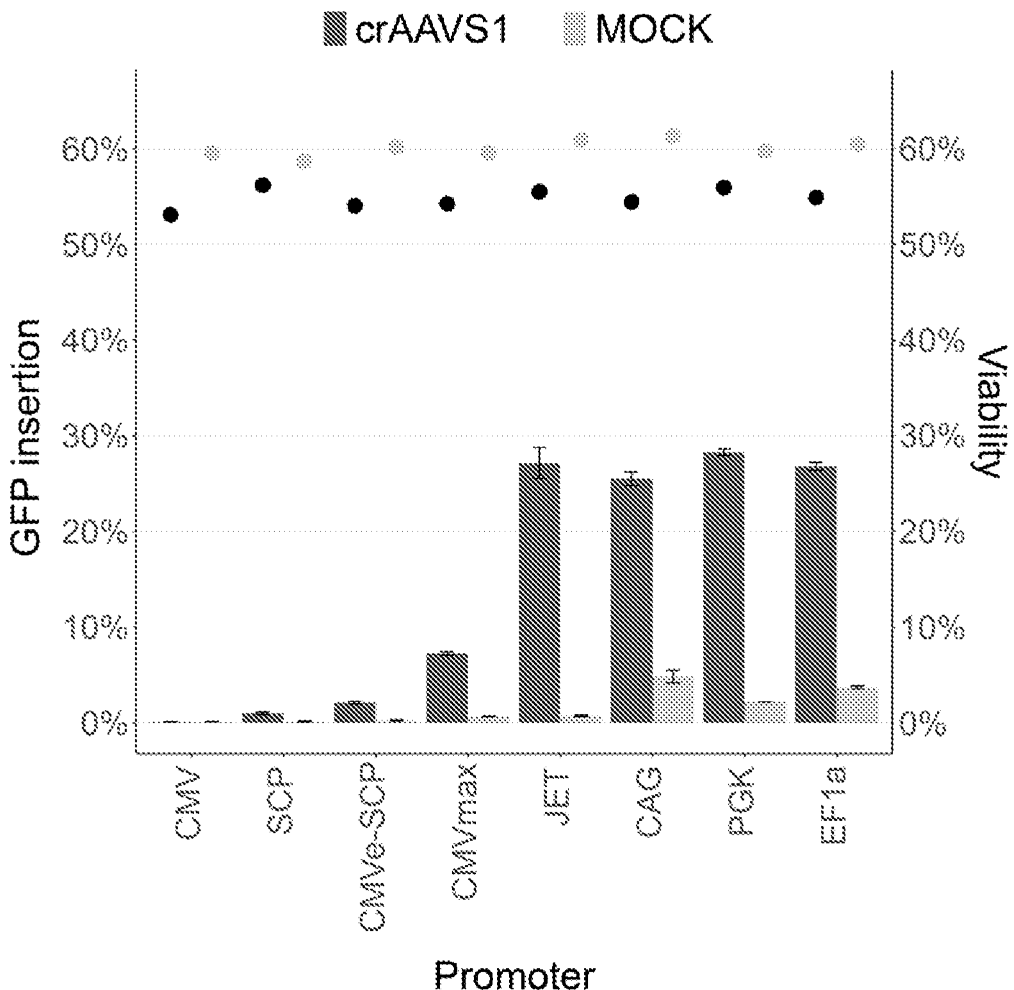
FIG. 18 shows GFP insertion efficiency at the AAVS1 locus and cell viability following treatment for multiple primer constructs.

The Jurkat T-cell leukemia cell line was used to evaluate the transgene insertion and expression efficiency using CRISPR-MAD7 RNP complexes. A highly active gNA targeting the AAVS1 (spacer sequence in Table 1) safe-harbor locus (FIG. 17) was used in combination with eight different HDR-repair templates flanked with symmetric homology arms (HA) of 500 base pairs (bp) in the amount of 0.5 μg $\mu L^{-1}$. Specifically, FIG. 17 shows INDEL frequency at the AAVS1 locus (n=3; Mean±SD) in T-cell leukemic cell line as a function of MAD7-RNP amounts (pmol; constant ratio of 1:1.5 MAD7:gNA). Dark grey bars represent mean INDEL frequency using crAAVS1. Light grey bars represent mean modification frequency using crIDTneg (IDT). The HDR inserts comprised eight promoters (Table 2) differing in both size and promoter strength to drive GFP expression (FIG. 18). When the transient GFP expression diminished at day 14 post-transfection, comparable insertion efficiencies were observed with stable GFP expressions of up to 30% using four (JET, PGK, EF1a, and CAG) out of eight promoters (FIG. 18), suggesting that the insert size has not affected the integration efficiency at AAVS1 in human T-cell leukemia cell line. Specifically, FIG. 18 shows GFP insertion efficiency at AAVS1 (n=3; Mean±SD) and cell viability of T-cell leukemic cell line measured at day 14 post-transfection. HDR templates consisting of eight different promoters and flanked with symmetric homology arms of 500 base pairs in the amount of 0.5 μg $\mu L^{-1}$ were used. Size of promoters in base pairs: CMV, 1400; SCP, 970; CMVe-SCP, 1270; CMVmax, 1830; JET, 1100; CAG, 2600; PGK, 1410; EF-1a, 2090. Dark grey bars and circles present mean insertion frequency and cell viability using crAAVS1. Light grey bars represent mean insertion frequency and cell viability using crIDTneg (IDT).

TABLE 2

| Name | SEQ ID NO | Sequence |
|---|---|---|
| CMV | 413 | CGTTACATAACTTACGGTAAATGGCCCGCCTGGCTGACCGCC CAACGACCCCCGCCCATTGACGTCAATAATGACGTATGTTCC CATAGTAACGCCAATAGGGACTTTCCATTGACGTCAATGGGT GGAGTATTTACGGTAAACTGCCCACTTGGCAGTACATCAAGT GTATCATATGCCAAGTACGCCCCCTATTGACGTCAATGACGG TAAATGGCCCGCCTGGCATTATGCCCAGTACATGACCTTATG GGACTTTCCTACTTGGCAGTACATCTACGTATTAGTCATCGC TATTACCATGGTGATGCGGTTTTGGCAGTACATCAATGGGCG TGGATAGCGGTTTGACTCACGGGGATTTCCAAGTCTCCACCC CATTGACGTCAATGGGAGTTTGTTTTGGCACCAAAATCAACG GGACTTTCCAAAATGTCGTAACAACTCCGCCCCATTGACGCA AATGGGCGGTAGGCGTGTACGGTGGGAGGTCTATATAAGCA GAGCT |
| SCP | 414 | GTACTTATATAAGGGGGTGGGGGCGCGTTCGTCCTCAGTCGC GATCGAACACTCGAGCCGAGCAGACGTGCCTACGGACCG |
| CMVe-SCP | 415 | CGTTACATAACTTACGGTAAATGGCCCGCCTGGCTGACCGCC CAACGACCCCCGCCCATTGACGTCAATAATGACGTATGTTCC CATAGTAACGCCAATAGGGACTTTCCATTGACGTCAATGGGT GGAGTATTTACGGTAAACTGCCCACTTGGCAGTACATCAAGT GTATCATATGCCAAGTACGCCCCCTATTGACGTCAATGACGG TAAATGGCCCGCCTGGCATTATGCCCAGTACATGACCTTATG GGACTTTCCTACTTGGCAGTACATCTACGTATTAGTCATCGC TATTACCATGGTACTTATATAAGGGGGTGGGGGCGCGTTCGT CCTCAGTCGCGATCGAACACTCGAGCCGAGCAGACGTGCCT ACGGACCG |
| CMVmax | 416 | TCAATATTGGCCATTAGCCATATTATTCATTGGTTATATAGC ATAAATCAATATTGGCTATTGGCCATTGCATACGTTGTATCT ATATCATAATATGTACATTTATATTGGCTCATGTCCAATATG ACCGCCATGTTGGCATTGATTATTGACTAGTTATTAATAGTA ATCAATTACGGGGTCATTAGTTCATAGCCCATATATGGAGTT CCGCGTTACATAACTTACGGTAAATGGCCCGCCTGGCTGACC GCCCAACGACCCCCGCCCATTGACGTCAATAATGACGTATGT TCCCATAGTAACGCCAATAGGGACTTTCCATTGACGTCAATG GGTGGAGTATTTACGGTAAACTGCCCACTTGGCAGTACATCA AGTGTATCATATGCCAAGTCCGCCCCCTATTGACGTCAATGA CGGTAAATGGCCCGCCTGGCATTATGCCCAGTACATGACCTT ACGGGACTTTCCTACTTGGCAGTACATCTACGTATTAGTCAT CGCTATTACCATGGTGATGCGGTTTTGGCAGTACACCAATGG GCGTGGATAGCGGTTTGACTCACGGGGATTTCCAAGTCTCCA CCCCATTGACGTCAATGGGAGTTTGTTTTGGCACCAAAATCA ACGGGACTTTCCAAAATGTCGTAATAACCCCGCCCCGTTGAC GCAAATGGGCGGTAGGCGTGTACGGTGGGAGGTCTATATAA GCAGAGGTCGTTTAGTGAACCGTCAGATCACTAGTAGCTTTA TTGCGGTAGTTTATCACAGTTAAATTGCTAACGCAGTCAGTG CTCGACTGATCACAGGTAAGTATCAAGGTTACAAGACAGGT TTAAGGAGGCCAATAGAAACTGGGCTTGTCGAGACAGAGAA GATTCTTGCGTTTCTGATAGGCACCTATTGGTCTTACTGACAT CCACTTTGCCTTTCTCTCCACAGGG |
| JET | 417 | GAATTCGGGCGGAGTTAGGGCGGAGCCAATCAGCGTGCGCC GTTCCGAAAGTTGCCTTTTATGGCTGGGCGGAGAATGGGCGG TGAACGCCGATGATTATATAAGGACGCGCCGGGTGTGGCAC AGCTAGTTCCGTCGCAGCCGGGATTTGGGTCGCGGTTCTTGT TTGTGGATCCCTGTGATCGTCACTTGACA |

TABLE 2-continued

| Name | SEQ ID NO | Sequence |
|---|---|---|
| CAG | 418 | ATCTCGACTAGTTATTAATAGTAATCAATTACGGGGTCATTA GTTCATAGCCCATATATGGAGTTCCGCGTTACATAACTTACG GTAAATGGCCCGCCTGGCTGACCGCCCAACGACCCCCGCCC ATTGACGTCAATAATGACGTATGTTCCCATAGTAACGCCAAT AGGGACTTTCCATTGACGTCAATGGGTGGAGTATTTACGGTA AACTGCCCACTTGGCAGTACATCAAGTGTATCATATGCCAAG TACGCCCCCTATTGACGTCAATGACGGTAAATGGCCCGCCTG GCATTATGCCCAGTACATGACCTTATGGGACTTTCCTACTTG GCAGTACATCTACGTATTAGTCATCGCTATTACCATGGTCGA GGTGAGCCCCACGTTCTGCTTCACTCTCCCCATCTCCCCCCC TCCCCACCCCCAATTTTGTATTTATTTATTTTTTAATTATTTTG TGCAGCGATGGGGGCGGGGGGGGGGGGGGGGCGCGCGCCA GGCGGGGCGGGGCGGGGCGAGGGGGGGGGGGGCGAGGC GGAGAGGTGCGGCGGCAGCCAATCAGAGCGGCGCGCTCCGA AAGTTTCCTTTTATGGCGAGGCGGCGGCGGCGGCGGCCCTAT AAAAAGCGAAGCGCGCGGCGGGCGGGGAGTCGCTGCGACG CTGCCTTCGCCCCGTGCCCCGCTCCGCCGCCGCCTCGCGCCG CCCGCCCCGGCTCTGACTGACCGCGTTACTCCCACAGGTGAG CGGGCGGGACGGCCCTTCTCCTCCGGGCTGTAATTAGCGCTT GGTTTAATGACGGCTTGTTTCTTTTCTGTGGCTGCGTGAAAG CCTTGAGGGGCTCCGGGAGGGCCCTTTGTGCGGGGGGAGCG GCTCGGGGGGTGCGTGCGTGTGTGTGTGCGTGGGGAGCGCC GCGTGCGGCTCCGCGCTGCCCGGCGGCTGTGAGCGCTGCGG GCGCGGCGCGGGGCTTTGTGCGCTCCGCAGTGTGCGCGAGG GGAGCGCGGCCGGGGGCGGTGCCCCGCGGTGCGGGGGGGGC TGCGAGGGGAACAAAGGCTGCGTGCGGGGTGTGTGCGTGGG GGGGTGAGCAGGGGGTGTGGGCGCGTCGGTCGGGCTGCAAC CCCCCCTGCACCCCCCTCCCCGAGTTGCTGAGCACGGCCCGG CTTCGGGTGCGGGGCTCCGTACGGGGCGTGGCGCGGGGCTC GCCGTGCCGGGCGGGGGGTGGCGGCAGGTGGGGGTGCCGGG CGGGGCGGGGCCGCCTCGGGCCGGGGAGGGCTCGGGGGAG GGGCGCGGCGGCCCCCGGAGCGCCGGCGGCTGTCGAGGCGC GGCGAGCCGCAGCCATTGCCTTTTATGGTAATCGTGCGAGAG GGCGCAGGGACTTCCTTTGTCCCAAATCTGTGCGGAGCCGAA ATCTGGGAGGCGCCGCCGCACCCCCTCTAGCGGGCGCGGGG CGAAGCGGTGCGGCGCCGGCAGGAAGGAAATGGGCGGGGA GGGCCTTCGTGCGTCGCCGCGCCGCCGTCCCCTTCTCCCTCT CCAGCCTCGGGGCTGTCCGCGGGGGGACGGCTGCCTTCGGG GGGGACGGGGCAGGGCGGGGTTCGGCTTCTGGCGTGTGACC GGCGGCTCTAGAGCCTCTGCTAACCATGTTCATGCCTTCTTCT TTTTCCTACAGCTCCTGGGCAACGTGCTGGTTATTGTGCTGTC TCATCATTTTGGCAAAGAATT |
| PGK | 419 | GGGGTTGGGGTTGCGCCTTTTCCAAGGCAGCCCTGGGTTTGC GCAGGGACGCGGCTGCTCTGGGCGTGGTTCCGGGAAACGCA GCGGCGCCGACCCTGGGTCTCGCACATTCTTCACGTCCGTTC GCAGCGTCACCCGGATCTTCGCCGCTACCCTTGTGGGCCCCC CGGCGACGCTTCCTGCTCCGCCCCTAAGTCGGGAAGGTTCCT TGCGGTTCGCGGCGTGCCGGACGTGACAAACGGAAGCCGCA CGTCTCACTAGTACCCTCGCAGACGGACAGCGCCAGGGAGC AATGGCAGCGCGCCGACCGCGATGGGCTGTGGCCAATAGCG GCTGCTCAGCAGGGCGCGCCGAGAGCAGCGGCCGGGAAGGG GCGGTGCGGGAGGCGGGGTGTGGGGCGGTAGTGTGGGCCCT GTTCCTGCCCGCGCGGTGTTCCGCATTCTGCAAGCCTCCGGA GCGCACGTCGGCAGTCGGCTCCCTCGTTGACCGAATCACCGA CCTCTCTCCCCAG |
| EF-1a | 420 | GAATTCAGGCTCCGGTGCCCGTCAGTGGGCAGAGCGCACAT CGCCCACAGTCCCCGAGAAGTTGGGGGGAGGGGTCGGCAAT TGAACCGGTGCCTAGAGAAGGTGGCGCGGGGTAAACTGGGA AAGTGATGTCGTGTACTGGCTCCGCCTTTTTCCCGAGGGTGG GGGAGAACCGTATATAAGTGCAGTAGTCGCCGTGAACGTTC TTTTTCGCAACGGGTTTGCCGCCAGAACACAGGTAAGTGCCG TGTGTGGTTCCCGCGGGCCTGGCCTCTTTACGGGTTATGGCC CTTGCGTGCCTTGAATTACTTCCACCTGGCTGCAGTACGTGA TTCTTGATCCCGAGCTTCGGGTTGGAAGTGGGTGGGAGAGTT CGAGGCCTTGCGCTTAAGGAGCCCCTTCGCCTCGTGCTTGAG TTGAGGCCTGGCCTGGGCGCTGGGGCCGCCGCGTGCGAATCT GGTGGCACCTTCGCGCCTGTCTCGCTGCTTTCGATAAGTCTCT AGCCATTTAAAATTTTTGATGACCTGCTGCGACGCTTTTTTTC TGGCAAGATAGTCTTGTAAATGCGGGCCAAGATCTGCACACT GGTATTTCGGTTTTTGGGGCCGCGGGCGGCGACGGGGCCCGT GCGTCCCAGCGCACATGTTCGGCGAGGCGGGGCCTGCGAGC GCGGCCACCGAGAATCGGACGGGGGTAGTCTCAAGCTGGCC GGCCTGCTCTGGTGCCTGGTCTCGCGCCGCCGTGTATCGCCC CGCCCTGGGCGGCAAGGCTGGCCCGGTCGGCACCAGTTGCG TGAGCGGAAAGATGGCCGCTTCCCGGCCCTGCTGCAGGGAG |

TABLE 2-continued

| Name | SEQ ID NO | Sequence |
|---|---|---|
| | | CTCAAAATGGAGGACGCGGCGCTCGGGAGAGCGGGCGGGTG AGTCACCCACACAAAGGAAAAGGGCCTTTCCGTCCTCAGCC GTCGCTTCATGTGACTCCACGGAGTACCGGGCGCCGTCCAGG CACCTCGATTAGTTCTCGAGCTTTTGGAGTACGTCGTCTTTAG GTTGGGGGGAGGGGTTTTATGCGATGGAGTTTCCCCACACTG AGTGGGTGGAGACTGAAGTTAGGCCAGCTTGGCACTTGATG TAATTCTCCTTGGAATTTGCCCTTTTTGAGTTTGGATCTTGGT TCATTCTCAAGCCTCAGACAGTGGTTCAAAGTTTTTTTCTTCC ATTTCAGGTGTCGTGACATCATTTT |

Figure 19:
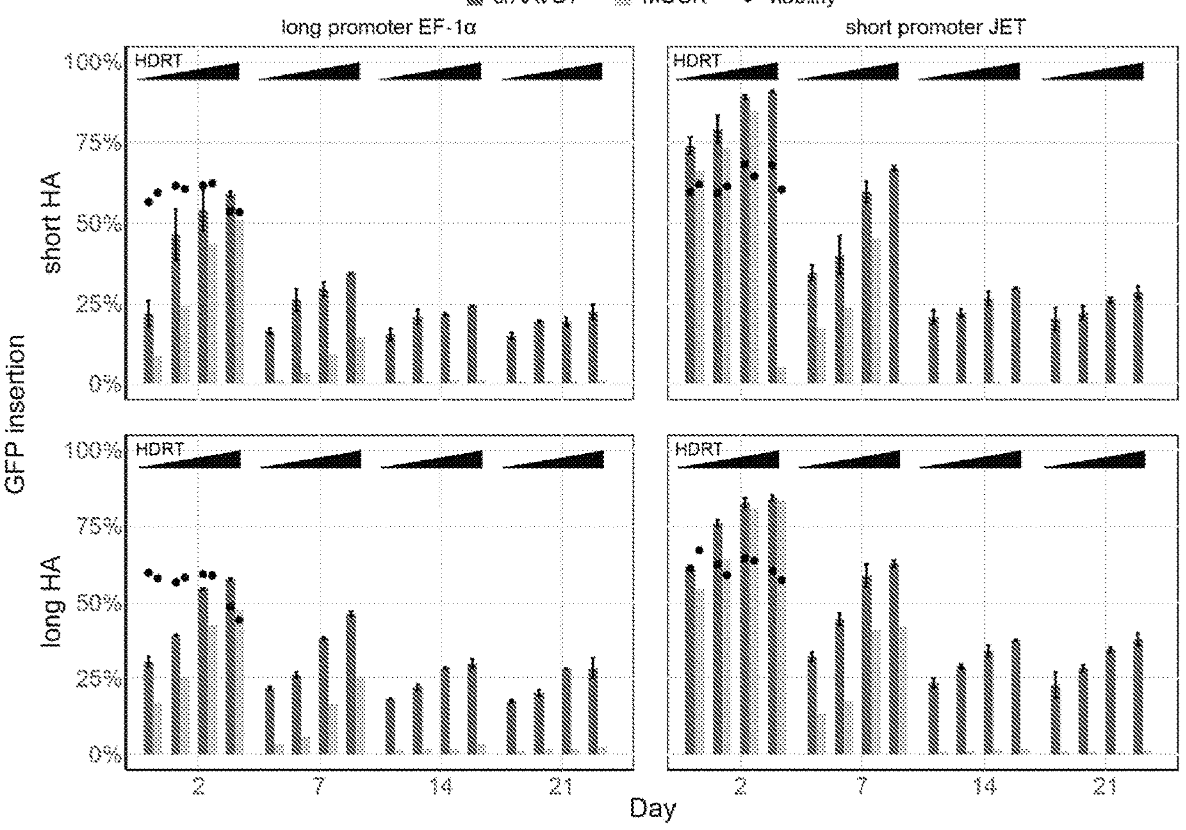
FIG. 19 shows GFP insertion efficiency at the AAVS1 locus with increasing concentrations of donor template (e.g., HDRT) and variable homology arm length.

Subsequently, keeping the MAD7-RNP amounts constant, the effect of various homology arm lengths (100 vs 500 bp) and HDR template amounts (0.125 μg μL$^{-1}$, 0.25 μg μL$^{-1}$, 0.5 μg μL$^{-1}$, and 1 μg μL$^{-1}$) on the insertion efficiency was evaluated using JET and EF1a promoters. Up to 30% higher integration efficiency was observed with HDR templates flanked with HA of 500 compared to 100 base pairs. Moreover, the data showed improved insertion efficiencies with increasing amounts of HDR templates flanked with either 100 or 500 base pair HA but at the same time somewhat reduced cell viability (FIG. 19). Specifically, FIG. 19 shows GFP insertion efficiency at AAVS1 (n=3; Mean±SD) in T-cell leukemic cell line measured at days 2, 7, 14, and 21 post-transfection as a function of donor template amount. No transient GFP expression was observed at day 21 post-transfection. Cell viability (black circles) was measured at day 2 post-transfection. Top panels display GFP insertion efficiencies using donor template flanked with short homology arms (100 bp HA), and bottom panels donor template flanked with long homology arms (500 bp HA). Left panels display GFP insertion efficiencies using donor template containing EF-1a promoter (long, ~2000 bp), and right panels donor template containing JET promoter (short, ~1000 bp). Amount of donor template, represented by the gradient above the bars, increases from 0.125, 0.25, 0.5 to 1 μg μL$^{-1}$. Dark grey bars represent mean insertion frequency using crAAVS1. Light grey bars represent mean insertion frequency using crIDTneg (IDT).

Figure 20:
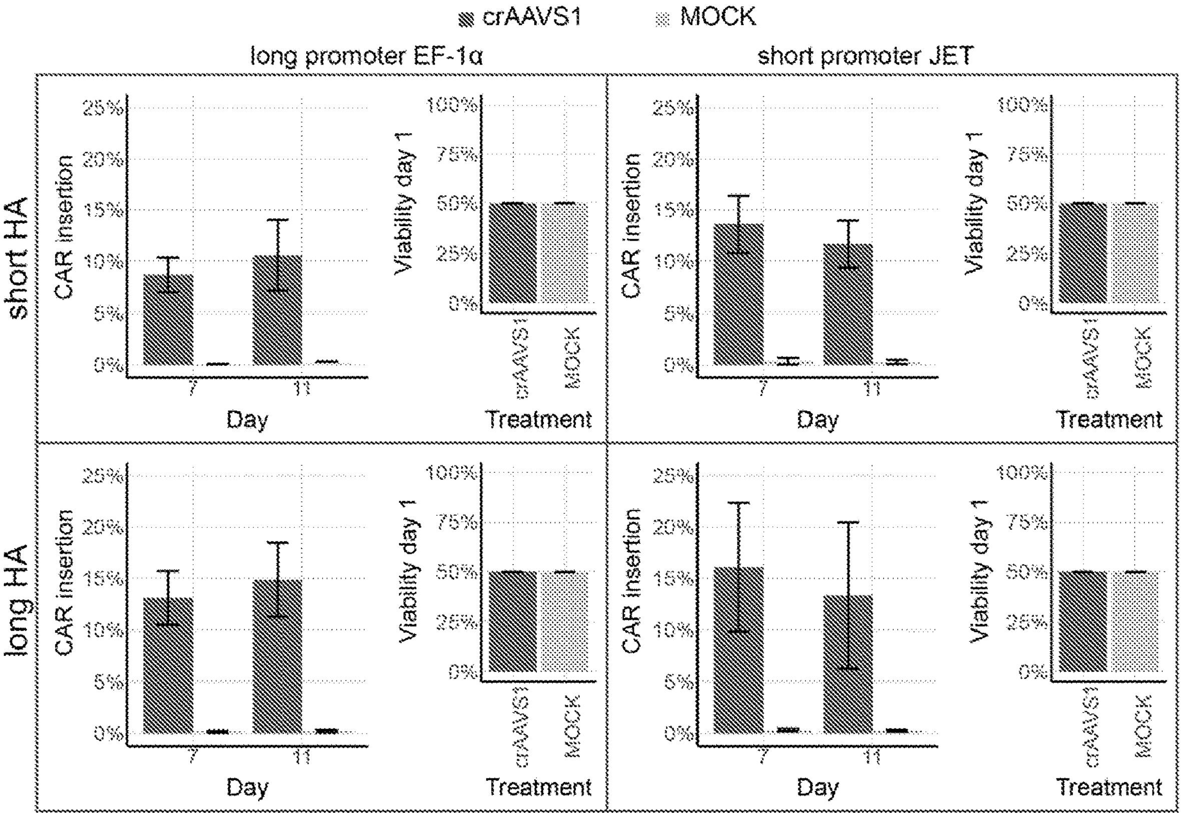
FIG. 20 shows CAR insertion efficiency at the AAVS1 locus and cell viability with increasing concentrations of donor template and variable homology arm length.

Next, using primary T-cells isolated from the human peripheral blood from three donors and a protocol selected from the experiments above, i.e., 150:100 pmol gNA:MAD7 RNP complex together with 1 μg μL$^{-1}$ HDR template, in combination with 100 μg μL$^{-1}$ poly-L-glutamic acid (PGA), integration efficiency of a clinically relevant CAR transgene containing JET or EF1a promoter flanked with HA of 100 or 500 base pairs and a bovine growth hormone derived polyadenylation sequence was analyzed. An anti-CD19 CAR with fully human variable regions (Hu19CAR), CD8a hinge and transmembrane domains, a CD28 costimulatory domain, and CD3 activation domain was used. Moderate insertion efficiency at AAVS1 but stable CAR expression of up to 14% and 16% was observed using HDR templates flanked with 100 and 500 base pair HA, respectively. The normalized cell viability measured 24 h post-transfection was in same cases relatively low, ranging from 22% with JET-500-CAR, 35% with JET-100-CAR, 43% with EF1a-100-CAR, to 55% with EF1a-500-CAR (FIG. 20). It is important to emphasize, that both CAR insertion efficiency and cell viability were higher in the treatment with PGA compared to the treatment without PGA (P≤0.05; data not shown). Specifically, FIG. 20 shows CAR insertion efficiency at AAVS1 (D=3; n=3; Mean±SD) in primary Pan T-cells measured at days 7 and 11 post-transfection. Cell viability was measured 24 hours post-transfection. Individual panels display CAR insertion efficiencies using donor template structure as described in FIG. 19. Amount of donor template, MAD7-RNP, and PGA was 1 μg μL$^{-1}$, 100:150 pmol MAD7:gNA, and 100 μg μL$^{-1}$, in that order. Nucleofection program P3-EH-115 for transfection of primary T-cells was used. D represents number of biological replicas, and n number of technical replicas per D. Dark grey bars represent mean insertion frequency using crAAVS1. Light grey bars represent mean insertion frequency using crIDT-neg (IDT).

Figure 21:
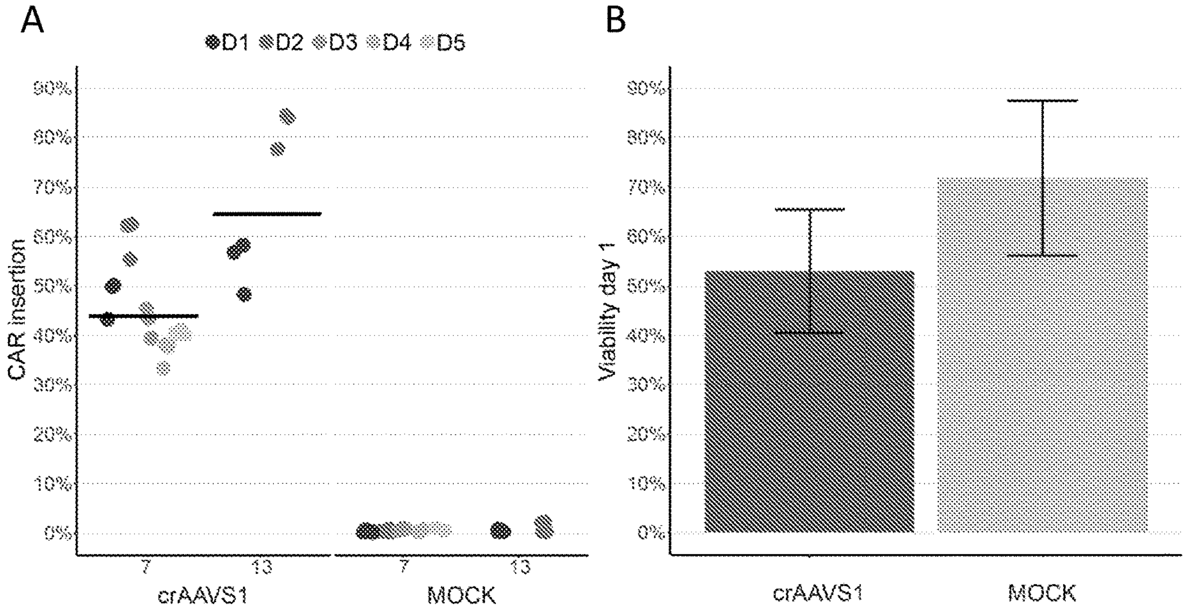
FIG. 21 shows CAR insertion efficiency (A) at the AAVS1 locus and cell viability (B) in primary T-cells.

Multiple parameters were reevaluated to further optimize primary T-cell viability and CAR insertion efficiencies at AAVS1. Using Pan T-cells isolated from the blood from two donors, the effect of RNP amount with 100 μg μL$^{-1}$ PGA and EF1a-500-CAR template amount on CAR insertion efficiency and cell viability was tested (data not shown). Reducing the RNP amount to 75:50 pmol gNA:MAD7 RNP complex while increasing the donor template amount to 1.5 μg μL$^{-1}$ led to improved CAR insertion efficiencies without significantly affecting cell viability (P≥0.05; data not shown). In addition, using the abovementioned transfection conditions in combination with the cell recovery in a post-transfection cultivation medium pretreated with 2 μM M3814 resulted in nearly 5-times more efficient CAR insertion than other experiments (FIG. 21). The optimized CRISPR-MAD7 transfection protocol resulted in CAR insertion efficiency of up to 85% 13-days post-transfection (median 65%) together with the median normalized cell viability as high as 62% 24 hours post-transfection. Specifically, FIG. 21 shows CAR insertion efficiency at AAVS1 (D=5; n=3) in primary Pan T-cells measured at day 7 post-transfection, and re-measured in two biological replicas at day 13 post-transfection (D=2; n=3). Cell viability was measured 24 hours post-transfection (D=5; n=3; Mean±SD). Amount or concentration of donor template, MAD7-RNP, PGA, and M3814 was 1.5 μg μL$^{-1}$, 50:75 pmol MAD7:gNA, 100 μg μL$^{-1}$, and 2 μM, respectively. Nucleofection program P3-EH-115 for transfection of primary T-cells was used. D represents number of biological replicas, and n number of technical replicas per D. Dark grey bars represent mean insertion frequency using crAAVS1. Light grey bars represent mean insertion frequency using crIDTneg (IDT).

EQUIVALENTS

Throughout the description, where compositions are described as having, including, or comprising specific components, or where processes and methods are described as having, including, or comprising specific steps, it is contemplated that, additionally, there are compositions of the present invention that consist essentially of, or consist of, the recited components, and that there are processes and methods according to the present invention that consist essentially of, or consist of, the recited processing steps.

In the application, where an element or component is said to be included in and/or selected from a list of recited elements or components, it should be understood that the element or component can be any one of the recited elements or components, or the element or component can be selected from a group consisting of two or more of the recited elements or components.

Further, it should be understood that elements and/or features of a composition or a method described herein can be combined in a variety of ways without departing from the spirit and scope of the present invention, whether explicit or implicit herein. For example, where reference is made to a particular compound, that compound can be used in various embodiments of compositions of the present invention and/or in methods of the present invention, unless otherwise understood from the context. In other words, within this application, embodiments have been described and depicted in a way that enables a clear and concise application to be written and drawn, but it is intended and will be appreciated that embodiments may be variously combined or separated without parting from the present teachings and invention(s). For example, it will be appreciated that all features described and depicted herein can be applicable to all aspects of the invention(s) described and depicted herein.

The terms "a" and "an" and "the" and similar references in the context of describing the invention (especially in the context of the following claims) are to be construed to cover both the singular and the plural, unless otherwise indicated herein or clearly contradicted by context. For example, the term "a cell" includes a plurality of cells, including mixtures thereof. Where the plural form is used for compounds, salts, or the like, this is taken to mean also a single compound, salt, or the like.

It should be understood that the expression "at least one of" includes individually each of the recited objects after the expression and the various combinations of two or more of the recited objects unless otherwise understood from the context and use. The expression "and/or" in connection with three or more recited objects should be understood to have the same meaning unless otherwise understood from the context.

The use of the term "include," "includes," "including," "have," "has," "having," "contain," "contains," or "containing," including grammatical equivalents thereof, should be understood generally as open-ended and non-limiting, for example, not excluding additional unrecited elements or steps, unless otherwise specifically stated or understood from the context.

Where the use of the term "about" is before a quantitative value, the present invention also includes the specific quantitative value itself, unless specifically stated otherwise. As used herein, the term "about" refers to a ±10% variation from the nominal value unless otherwise indicated or inferred.

It should be understood that the order of steps or order for performing certain actions is immaterial so long as the present invention remain operable. Moreover, two or more steps or actions may be conducted simultaneously.

The use of any and all examples, or exemplary language herein, for example, "such as" or "including," is intended merely to illustrate better the present invention and does not pose a limitation on the scope of the invention unless claimed. No language in the specification should be construed as indicating any non-claimed element as essential to the practice of the present invention.

The invention may be embodied in other specific forms without departing from the spirit or essential characteristics thereof. The foregoing embodiments are therefore to be considered in all respects illustrative rather than limiting on the invention described herein. Scope of the invention is thus indicated by the appended claims rather than by the foregoing description, and all changes that come within the meaning and range of equivalency of the claims are intended to be embraced therein.

EMBODIMENTS

In embodiment 1 provided herein is a composition comprising a nucleic acid-guided nuclease comprising a Type V CRISPR nuclease polypeptide comprising at least one nuclear localization signal (NLS) at or near the N-terminus or the C-terminus of the polypeptide. In embodiment 2 provided herein is the composition of embodiment 1 wherein the nuclease is a Type Va nuclease. In embodiment 3 provided herein is the composition of embodiment 1 or embodiment 2 wherein the Type V CRISPR nuclease polypeptide has at least 60, 70, 80, 85, 90, 95, 96, 97, 98, 99, or 100% sequence identity, preferably at least 80%, more preferably at least 90%, even more preferably at least 95%, still more preferably at least 98% sequence identity with SEQ ID NO: 1. In embodiment 4 provided herein is the composition of any previous embodiment wherein the Type V CRISPR nuclease polypeptide comprises two NLSs, one or both of which are at or near the N-terminus or the C-terminus of the polypeptide. In embodiment 5 provided herein is the composition of any previous embodiment wherein the Type V CRISPR nuclease polypeptide comprises three NLSs, each of which is at or near the N-terminus or the C-terminus of the polypeptide. In embodiment 6 provided herein is the composition of any previous embodiment wherein the Type V CRISPR nuclease polypeptide comprises four NLSs, each of which is at or near the N-terminus or the C-terminus of the polypeptide. In embodiment 7 provided herein is the composition of any previous embodiment wherein the Type V CRISPR nuclease polypeptide comprises at least five NLSs, each of which is at or near the N-terminus or the C-terminus of the polypeptide. In embodiment 8 provided herein is the composition of any one of embodiments 4 through 7 wherein at least two of the NLSs are at or near the N-terminus of the polypeptide. In embodiment 9 provided herein is the composition of any one of embodiments 5 through 7 wherein at least three of the NLSs are at or near the N-terminus of the polypeptide. In embodiment 10 provided herein is the composition of any one of embodiments 6 through 7 wherein at least four of the NLSs are at or near the N-terminus of the polypeptide. In embodiment 11 provided herein is the composition of embodiment 7 wherein the 5 NLSs are at or near the N-terminus of the polypeptide. In embodiment 12 provided herein is the composition of embodiment 11 comprising a sequence at least 60, 70, 80, 85, 90, 95, 98, 99%, or 100%, identical, preferably at least 80%, more preferably at least 90%, even more preferably at least 95%, still more preferably at least 98% identical to any one of SEQ ID NOs: 109-112. In embodiment 13 provided herein is the composition of any one of embodiments 1 through 3 wherein the Type V CRISPR nuclease polypeptide comprises at least 1-30, 1-20, 1-15, 1-10, 1-9, 1-8, 1-7, 1-6, 1-5, 2-30, 2-20, 2-15, 2-10, 2-9, 2-8, 2-7, 2-6, 2-5, 3-30, 3-20, 3-15, 3-10, 3-9, 3-8, 3-7, 3-6, or 3-5, preferably 1-10, more preferably 2-10, even more preferably 3-10 NLSs, each of which is at or near the N-terminus or the C-terminus of the polypeptide.

In embodiment 14 provided herein is the composition of any one of embodiments 4 through 11 wherein at least two of the NLSs have different nuclear localization mechanisms. In embodiment 15 provided herein is the composition of any one of embodiments 5 through 7 or 9 through 11 wherein at least three of the NLSs have different nuclear localization mechanisms. In embodiment 16 provided herein is the composition of any previous embodiment wherein one or more of the NLSs comprises an NLS of the SV40 virus large T-antigen, an NLS from nucleoplasmin, e.g. a nucleoplasmin bipartite NLS, a c-myc NLS; a hRNPA1 M9 NLS; an IBB domain of importin-alpha NLS; a myoma T protein NLS; a sequence from human p53 NLS; a sequence of mouse c-abl IV NLS; a sequence of influenza virus NS1 NLS; a sequence of Hepatitis virus delta antigen NLS; a sequence of mouse Mx1 protein NLS; a sequence of human poly(ADP-ribose) polymerase NLS; a sequence of steroid hormone receptors (human) glucocorticoid NLS; and/or a sequence of EGL-13 NLS. In embodiment 17 provided herein is the composition of embodiment 16 wherein one or more of the NLSs comprises an NLS of the SV40 virus large T-antigen. In embodiment 18 provided herein is the composition of embodiment 16 wherein two or more of the NLSs comprises an NLS of the SV40 virus large T-antigen. In embodiment 19 provided herein is the composition of embodiment 17 or embodiment 18 wherein the NLS or NLSs comprises the sequence of SEQ ID NO: 5. In embodiment 20 provided herein is the composition of any one of embodiments 16 through 19 wherein one or more of the NLSs comprises an NLS from nucleoplasmin. In embodiment 21 provided herein is the composition of embodiment 20 wherein the nucleoplasmin NLS comprises the sequence of SEQ ID NO: 6. In embodiment 22 provided herein is the composition of any one of embodiments 16 through 21 wherein one or more of the NLSs comprises a c-myc NLS. In embodiment 23 provided herein is the composition of embodiment 22 wherein the c-myc NLS comprises the sequence of SEQ ID NO: 7, SEQ ID NO: 8, or SEQ ID NO: 21. In embodiment 24 provided herein is the composition of embodiment 23 wherein the c-myc NLS comprises the sequence of SEQ ID NO: 21. In embodiment 25 provided herein is the composition of any one of embodiments 16 through 24 wherein one or more of the NLSs comprises a sequence of EGL-13 NLS. In embodiment 26 provided herein is the composition of embodiment 25 wherein the EGL-13 NLS comprises the sequence of SEQ ID NO: 107. In embodiment 27 provided herein is the composition of any previous embodiment wherein the Type V CRISPR nuclease polypeptide further comprises a purification tag. In embodiment 28 provided herein is the composition of embodiment 27 wherein the purification tag is at or near the N-terminus of the nuclease polypeptide. In embodiment 29 provided herein is the composition of embodiment 27 or embodiment 28 wherein the purification tag comprises a poly-his tag, such as a Gly-6×His tag (SEQ ID NO: 421) or Gly-8×His tag (SEQ ID NO: 422); short epitope tags, e.g., FLAG, hemagglutinin (HA), c-myc, T7, Glu-Glu; maltose binding protein (mbp); N-terminal glutathione S-transferase (GST); or calmodulin binding peptide (CBP) In embodiment 30 provided herein is the composition of embodiment 29 wherein the purification tag comprises a poly-his tag. In embodiment 31 provided herein is the composition of embodiment 30 wherein the purification tag comprises a gly-6×His tag (SEQ ID NO: 421). In embodiment 32 provided herein is the composition of embodiment 30 wherein the purification tag comprises a gly-8×His tag (SEQ ID NO: 422). In embodiment 33 provided herein is the composition of any previous embodiment wherein the Type V CRISPR nuclease polypeptide comprises a cleavage site. In embodiment 34 provided herein is the composition of embodiment 33 wherein the cleavage site is at or near the N-terminus of the nuclease polypeptide. In embodiment 35 provided herein is the composition of embodiment 33 or embodiment 34 wherein the cleavage site comprises a Tobacco Etch Virus (TEV) cleavage site. In embodiment 36 provided herein is the composition of embodiment 35 wherein the cleavage site comprises the sequence of SEQ ID NO: 108. In embodiment 37 provided herein is the composition of embodiment 36 comprising 5 NLSs at or near the N-terminus of the polypeptide, a purification tag, and the cleavage site, wherein the cleavage site is after the purification tag. In embodiment 38 provided herein is the composition of embodiment 37 comprising a sequence at least 60, 70, 80, 85, 90, 95, 98, 99%, or 100%, identical, preferably at least 8%, more preferably at least 90%, even more preferably at least 95%, still more preferably at least 98% identical to SEQ ID NO: 111 or 112. In embodiment 39 provided herein is the composition of embodiment 37 comprising a sequence at least 60, 70, 80, 85, 90, 95, 98, 99%, or 100%, identical, preferably at least 8%, more preferably at least 90%, even more preferably at least 95%, still more preferably at least 98% identical to SEQ ID NO: 112. In embodiment 40 provided herein is the composition of any previous embodiment further comprising a guide nucleic acid (gNA), e.g., gRNA, comprising a spacer sequence that targets a target nucleotide sequence within a polynucleotide, or a polynucleotide coding for the gNA, e.g., gRNA, wherein the gNA, e.g., gRNA is compatible with the Type V CRISPR nuclease. In embodiment 41 provided herein is the composition of embodiment 40 wherein the target nucleotide is within 50 nucleotides of a protospacer adjacent motif (PAM) sequence specific for the Type V CRISPR nuclease. In embodiment 42 provided herein is the composition of embodiment 41 wherein the PAM comprises a sequence of YTTN, wherein Y is T or C and Nis A, T, G, or C. In embodiment 43 provided herein is the composition of embodiment 42 wherein the PAM comprises a sequence of YTTV or TTTV, wherein V is A, G, or C. In embodiment 44 provided herein is the composition of embodiment 40 wherein the gNA is a gRNA. In embodiment 45 provided herein is the composition of embodiment 44 wherein the gRNA is a dual gRNA. In embodiment 46 provided herein is the composition of embodiment 44 or embodiment 45 wherein the composition comprises the gRNA and the gRNA comprises one or more chemical modifications. In embodiment 47 provided herein is the composition of embodiment 46 wherein the chemical modification comprises a 2'-O-alkyl, a 2'-O-methyl, a phosphorothioate, a phosphonoacetate, a thiophosphonoacetate, a 2'-O-methyl-3'-phosphorothioate, a 2'-O-methyl-3'-phosphonoacetate, a 2'-O-methyl-3'-thiophosphonoacetate, a 2'-deoxy-3'-phosphonoacetate, a 2'-deoxy-3'-thiophosphonoacetate, a suitable alternative, or a combination thereof. In embodiment 48 provided herein is the composition of any one of embodiments 44 through 47 wherein a ratio of guanine:uracil in the gRNA is at least 51:49, 52:48, 53:47, 54:46, 55:45, 56:44, 57:43, 58:42, 59:42, or 60:40, preferably at least 53:47, more preferably at least 54:46, even more preferably at least 55:45. In embodiment 49 provided herein is the composition of any one of embodiments 40 through 48 wherein the molar ratio of gNA, e.g., gRNA to Type V CRISPR nuclease is at least 1.1:1, 1.2:1, 1.3:1, 1.4:1, 1.5:1, 1.6:1, 1.7:1, 1.8:1, 2:1, 2.2:1, 2.5:1, or 3:1 and/or not more than 1.2:1, 1.3:1, 1.4:1, 1.5:1, 1.6:1, 1.7:1, 1.8:1, 2:1, 2.2:1, 2.5:1, 3:1, or 4:1, preferably 1.1:1 to 2.5:1, more preferably 1.2:1 to 2:1, even more preferably 1.2:1 to 1.7:1. In embodiment 50 provided herein is the composition of any one of embodiments 40 through 49 wherein the molar amount of gNA, e.g., gRNA, is at least 10, 25, 30, 35, 40, 45, 50, 55, 60, 65, 70, 75, 80, 85, 90, 95, 100, 110, 120, 130, 140, 150, 170, 190 or 200 pmol and/or not more than 30, 35, 40, 45, 50, 55, 60, 65, 70, 75, 80, 85, 90, 95, 100, 110, 120, 130, 140, 150, 170, 190, 200, 250, or 300 pmol, preferably 25-200 pmol, more preferably 50-100 pmol, even more preferably 65 to 85 pmol. In embodiment 51 provided herein is the composition of any one of embodiments 40 through 50 further comprising a donor template. In embodiment 52 provided herein is the composition of embodiment 51 wherein the donor template comprises homology arms. In embodiment 53 provided herein is the composition of embodiment 51 or embodiment 52 wherein the donor template is present in an amount of at least 0.1, 0.2, 0.3, 0.4, 0.5, 0.6, 0.7, 0.8, 0.9, 1, 1.1, 1.2, 1.3, 1.4, 1.5, 1.7, 2, 2.5, 3, 4, or 5 μg μL−1 and/or not more than 0.2, 0.3, 0.4, 0.5, 0.6, 0.7, 0.8, 0.9, 1, 1.1, 1.2, 1.3, 1.4, 1.5, 1.7, 2, 2.5, 3, 4, 5, 7, or 10 μg μL−1, preferably 0.3 to 2 μg μL−1, more preferably 0.5 to 1.5 μg μL−1, even more preferably 0.8 to 1.2 μg μL−1. In embodiment 54 provided herein is the composition of any one of embodiments 40 through 53 further comprising an anionic polymer. In embodiment 55 provided herein is the composition of embodiment 54 wherein the anionic polymer comprises polyglutamic acid (PGA). In embodiment 56 provided herein is the composition of embodiment 54 or embodiment 55 wherein the anionic polymer is present at a concentration of at least 20, 50, 60, 70, 80, 90, 100, 110, 120, 130, 140, 150, 170, 200, 250, 300, 400, or 500 μg μL−1 and/or not more than 50, 60, 70, 80, 90, 100, 110, 120, 130, 140, 150, 170, 200, 250, 300, 400, 500, 700, or 1000 μg μL−1, preferably 20 to 200 μg μL−1, more preferably 50 to 150 μg μL−1, even more preferably 80 to 120 μg μL−1.

In embodiment 57 provided herein is a cell containing the composition of any previous embodiment. In embodiment 58 provided herein is the cell of embodiment 56 wherein the cell is a human cell. In embodiment 59 provided herein is the cell of embodiment 58 wherein the cell is an immune cell or a stem cell. In embodiment 60 provided herein is the cell of embodiment 59 wherein the cell is an immune cell. In embodiment 61 provided herein is the cell of embodiment 60 wherein the cell is a T cell. In embodiment 62 provided herein is the cell of embodiment 59 wherein the cell is a stem cell. In embodiment 63 provided herein is the cell of embodiment 62 wherein the cell is an induced pluripotent stem cell (iPSC).

In embodiment 64 provided herein is a method comprising inserting a composition of any one of embodiments 1 through 56 into a cell. In embodiment 65 provided herein is the method of embodiment 64 wherein inserting the composition into the cell comprises electroporation.

In embodiment 66 provided herein is a method for modifying a target polynucleotide comprising (i) contacting the composition of any one of embodiments 40 through 56 and (ii) allowing the nuclease and the guide nucleic acid to modify a targeted genomic region. In embodiment 67 provided herein is the method of embodiment 66 wherein the composition is a composition of any one of embodiments 51 through 56. In embodiment 68 provided herein is the method of embodiment 66 or embodiment 67 wherein the target polynucleotide is a genome or a portion of a genome within a cell. In embodiment 69 provided herein is the method of embodiment 68 wherein the cell is a human cell. In embodiment 70 provided herein is the method of embodiment 69 wherein the cell is an immune cell or a stem cell. In embodiment 71 provided herein is the method of embodiment 70 wherein the cell is an immune cell. In embodiment 72 provided herein is the method of embodiment 71 wherein the cell is a T cell. In embodiment 73 provided herein is the method of embodiment 70 wherein the cell is a stem cell. In embodiment 74 provided herein is the method of embodiment 73 wherein the stem cell is an iPSC In embodiment 75 provided herein is the method of any one of embodiments 67 through 74 wherein the donor template comprises a mutation in a PAM within 50 nucleotides of the target nucleotide sequence in the target polynucleotide. In embodiment 76 provided herein is the method of any one of embodiments 68 through 74 wherein the composition is a composition of embodiment 67 and the donor template comprises a polynucleotide coding for a polypeptide to be expressed by the cell. In embodiment 77 provided herein is the method of embodiment 76 wherein the polypeptide to be expressed by the cell comprises a chimeric antigen receptor (CAR) or a portion thereof. In embodiment 78 provided herein is the method of embodiment 77 wherein the cell is a human T cell or a human iPSC. In embodiment 79 provided herein is the method of embodiment 77 wherein the cell is a human T cell. In embodiment 80 provided herein is the method of embodiment 77 wherein the cell is a human iPSC.

In embodiment 81 provided herein is a composition comprising a first polynucleotide coding for a polypeptide comprising a nucleic acid-guided nuclease comprising a CRISPR Type V nuclease polypeptide, wherein the polynucleotide has less than 75% sequence identity to SEQ ID NO: 22. In embodiment 82 provided herein is the composition of embodiment 81 wherein the nuclease polypeptide comprises at least 1, 2, 3, 4, or 5 NLSs, wherein each of the NLSs is at or near the N-terminus or the C-terminus of the nuclease polypeptide. In embodiment 83 provided herein is the composition of embodiment 82 wherein one or more of the NLSs comprises an NLS of the SV40 virus large T-antigen, an NLS from nucleoplasmin, e.g. a nucleoplasmin bipartite NLS, a c-myc NLS; a hRNPA1 M9 NLS; an IBB domain of importin-alpha NLS; a myoma T protein NLS; a sequence from human p53 NLS; a sequence of mouse c-abl IV NLS; a sequence of influenza virus NS1 NLS; a sequence of Hepatitis virus delta antigen NLS; a sequence of mouse Mx1 protein NLS; a sequence of human poly(ADP-ribose) polymerase NLS; a sequence of steroid hormone receptors (human) glucocorticoid NLS; and/or a sequence of EGL-13 NLS. In embodiment 84 provided herein is the composition of embodiment 83 wherein one or more of the NLSs comprises an NLS of the SV40 virus large T-antigen. In embodiment 85 provided herein is the composition of embodiment 84 wherein the NLS or NLSs comprises the sequence of SEQ ID NO: 5. In embodiment 86 provided herein is the composition of any one of embodiments 83 through 85 wherein one or more of the NLSs comprises an NLS from nucleoplasmin. In embodiment 87 provided herein is the composition of embodiment 86 wherein the nucleoplasmin NLS comprises the sequence of SEQ ID NO: 6. In embodiment 88 provided herein is the composition of any one of embodiments 83 through 87 wherein one or more of the NLSs comprises a c-myc NLS. In embodiment 89 provided herein is the composition of embodiment 88 wherein the c-myc NLS comprises the sequence of SEQ ID NO: 7, SEQ ID NO: 8, or SEQ ID NO: 21. In embodiment 90 provided herein is the composition of embodiment 88 wherein the c-myc NLS comprises the sequence SEQ ID NO: 21. In embodiment 91 provided herein is the composition of any one of embodiments 83 through 90 wherein one or more of the NLSs comprises a sequence of EGL-13 NLS. In embodiment 92 provided herein is the composition of embodiment 91 wherein the EGL-13 NLS comprises the sequence of SEQ ID NO: 107. In embodiment 93 provided herein is the composition of any one of embodiments 82 through 92 wherein the NLS or NLSs is at or near the N-terminus of the polypeptide. In embodiment 94 provided herein is the composition of any one of embodiments 81 through 93 wherein the first polynucleotide comprises a polynucleotide coding for a purification tag. In embodiment 95 provided herein is the composition of embodiment 94 wherein the purification tag is at or near the N-terminus of the nuclease polypeptide. In embodiment 96 provided herein is the composition of embodiment 94 or 95 wherein the purification tag comprises a poly-his tag, such as a Gly-6×His tag (SEQ ID NO: 421) or Gly-8×His tag (SEQ ID NO: 422); short epitope tags, e.g., FLAG, hemagglutinin (HA), c-myc, T7, Glu-Glu; maltose binding protein (mbp); N-terminal glutathione S-transferase (GST); or calmodulin binding peptide (CBP). In embodiment 97 provided herein is the composition of embodiment 96 wherein the purification tag comprises a poly-his tag. In embodiment 98 provided herein is the composition of embodiment 97 wherein the purification tag comprises a gly-6×His tag (SEQ ID NO: 421). In embodiment 99 provided herein is the composition of embodiment 97 wherein the purification tag comprises a gly-8×His tag (SEQ ID NO: 422). In embodiment 100 provided herein is the composition of any one of embodiments 81 through 99 wherein the Type V CRISPR nuclease polypeptide comprises a cleavage site. In embodiment 101 provided herein is the composition of embodiment 100 wherein the cleavage site is at or near the N-terminus of the nuclease polypeptide. In embodiment 102 provided herein is the composition of embodiment 100 or 101 wherein the cleavage site comprises a Tobacco Etch Virus (TEV) cleavage site. In embodiment 103 provided herein is the composition of embodiment 102 wherein the cleavage site comprises the sequence of SEQ ID NO: 108. In embodiment 104 provided herein is the composition of embodiment 103 comprising 5 NLSs at or near the N-terminus of the polypeptide, a purification tag, and the cleavage site, wherein the cleavage site is after the purification tag. In embodiment 105 provided herein is the composition of any one of embodiments 81 through 104 wherein the polynucleotide codes for a polypeptide comprising a sequence at least 60, 70, 80, 85, 90, 95, 98, 99%, or 100%, identical, preferably at least 80%, more preferably at least 90%, even more preferably at least 95%, still more preferably at least 98% identical to any one of SEQ ID NOs: 109-112 In embodiment 106 provided herein is the composition of any one of embodiments 81 through 105 wherein the polynucleotide codes for a polypeptide comprising a sequence at least 60, 70, 80, 85, 90, 95, 98, 99%, or 100%, preferably at least 80%, more preferably at least 90%, even more preferably at least 95%, still more preferably at least 98% identical to SEQ ID NO: 112. In embodiment 107 provided herein is the composition of any one of embodiments 81 through 105 wherein the first polynucleotide comprises a sequence at least 50, 60, 70, 80, 90, 95, 97, or 99% identical, or 100% identical, preferably at least 80%, more preferably at least 90%, even more preferably at least 95%, still more preferably at least 98% identical to SEQ ID NO: 113. In embodiment 108 provided herein is the composition of any one of embodiments 81 through 107 further comprising a second polynucleotide coding for a gNA or portion thereof, wherein the gNA, e.g., gRNA, comprises a spacer sequence that targets a target nucleotide sequence within a polynucleotide, or a polynucleotide coding for the gNA, e.g., gRNA, wherein the gNA, e.g., gRNA is compatible with the Type V CRISPR nuclease. In embodiment 109 provided herein is the composition of embodiment 108 wherein the first and second polynucleotides are the same. In embodiment 110 provided herein is the composition of any one of embodiments 81 through 109 further comprising third polynucleotide that comprises a donor template.

In embodiment 111 provided herein is a vector comprising the polynucleotide or polynucleotides of any one of embodiments 81 through 110.

In embodiment 112 provided herein is a cell comprising a composition of any one of embodiments 81 through 110. In embodiment 113 provided herein is the composition of embodiment 112 wherein the cell is a human cell. In embodiment 114 provided herein is the composition of embodiment 113 wherein the cell is an immune cell or a stem cell. In embodiment 115 provided herein is the composition of embodiment 113 wherein the cell is an immune cell. In embodiment 116 provided herein is the composition of embodiment 115 wherein the cell is T cell. In embodiment 117 provided herein is the composition of embodiment 113 wherein the cell is a stem cell. In embodiment 118 provided herein is the composition of embodiment 117 wherein the cell is an iPSC.

In embodiment 119 provided herein is a method comprising inserting the composition of any one of embodiments 81 through 111 into a cell. In embodiment 120 provided herein is the method of embodiment 119 wherein inserting the composition into the cell comprises electroporation.

In embodiment 121 provided herein is a method comprising (i) inserting a composition of any one of embodiments 81 through 107 into a cell and (ii) inserting a gNA, e.g. a gRNA, compatible with the Type V CRISPR nuclease coded for by the composition, into the cell. In embodiment 122 provided herein is the method of embodiment 121 wherein steps (i) and (ii) comprise electroporation.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (487 sequences)

SEQ ID NO: 1 - protein, 1263 aa, Artificial Sequence
  Description of Artificial Sequence: Synthetic polypeptide
MNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQTEYRKAIHKKFANDDRFKNMFSAKLISDILPEFVIHNNNYSASEKEEKTQVIKLFSRFATSFKDYFKNRANCFSADDISSSSCHRIVNDNAEIFFSNALVYRRIVKSLSNDDINKISGDMKDSLKEMSLEEIYSYEKYGEFITQEGISFYNDICGKVNSFMNLYCQKNKENKNLYKLQKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCSDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHIKSSKDFDITFCHDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKNIPENIYQELYKYFNDKSDKELSDEAAKLKNVVGHHEAATNIVKDYRYTYDKYFLHMPITINFKANKTGFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFRLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 2 - protein, 1342 aa, Artificial Sequence
  Description of Artificial Sequence: Synthetic polypeptide
MGHHHHHHSSGVDLGTENLYFQSPAAKKKKLDGSVDMNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQTEYRKAIHKKFANDDRFKNMFSAKLISDILPEFVIHNNNYSASEKEEKTQVIKLFSRFATSFKDYFKNRANCFSADDISSSSCHRIVNDNAEIFFSNALVYRRIVKSLSNDDINKISGDMKDSLKEMSLEEIYSYEKYGEFITQEGISFYNDICGKVNSFMNLYCQKNKENKNLYKLQKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCSDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHIKSSKDFDITFCHDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKNIPENIYQELYKYFNDKSDKELSDEAAKLKNVVGHHEAATNIVKDYRYTYDKYFLHMPITINFKANKTGFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFRLTVQMRNSLSELEDRDYDRLISPVLNENNIFYDSAKAGDALPKDADANGAYCIALKGLYEIKQITENWKEDGKFSRDKLKISNKDWFDFIQNKRYLKRPAATKKAGQAKKKKASGSGAGSPKKKRKVEDPKKKRKVIPG

SEQ ID NO: 3 - protein, 1320 aa, Artificial Sequence
  Description of Artificial Sequence: Synthetic polypeptide
SPAAKKKKLDGSVDMNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQTEYRKAIHKKFANDDRFKNMFSAKLISDILPEFVIHNNNYSASEKEEKTQVIKLFSRFATSFKDYFKNRANCFSADDISSSSCHRIVNDNAEIFFSNALVYRRIVKSLSNDDINKISGDMKDSLKEMSLEEIYSYEKYGEFITQEGISFYNDICGKVNSFMNLYCQKNKENKNLYKLQKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCSDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHIKSSKDFDITFCHDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKNIPENIYQELYKYFNDKSDKELSDEAAKLKNVVGHHEAATNIVKDYRYTYDKYFLHMPITINFKANKTGFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFRLTVQMRNSLSELEDRDYDRLISPVLNENNIFYDSAKAGDALPKDADANGAYCIALKGLYEIKQITENWKEDGKFSRDKLKISNKDWFDFIQNKRYLKRPAATKKAGQAKKKKASGSGAGSPKKKRKVEDPKKKRKVIPG

SEQ ID NO: 4 - protein, 1319 aa, Artificial Sequence
  Description of Artificial Sequence: Synthetic polypeptide
PAAKKKKLDGSVDMNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQTEYRKAIHKKFANDDRFKNMFSAKLISDILPEFVIHNNNYSASEKEEKTQVIKLFSRFATSFKDYFKNRANCFSADDISSSSCHRIVNDNAEIFFSNALVYRRIVKSLSNDDINKISGDMKDSLKEMSLEEIYSYEKYGEFITQEGISFYNDICGKVNSFMNLYCQKNKENKNLYKLQKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCSDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHIKSSKDFDITFCHDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKNIPENIYQELYKYFNDKSDKELSDEAAKLKNVVGHHEAATNIVKDYRYTYDKYFLHMPITINFKANKTGFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFRLTVQMRNSLSELEDRDYDRLISPVLNENNIFYDSAKAGDALPKDADANGAYCIALKGLYEIKQITENWKEDGKFSRDKLKISNKDWFDFIQNKRYLKRPAATKKAGQAKKKKASGSGAGSPKKKRKVEDPKKKRKVIPG

SEQ ID NO: 5 - protein, 7 aa, Artificial Sequence
  Description of Artificial Sequence: Synthetic peptide
PKKKRKV

SEQ ID NO: 6 - protein, 16 aa, Artificial Sequence
  Description of Artificial Sequence: Synthetic peptide
KRPAATKKAGQAKKKK

SEQ ID NO: 7 - protein, 9 aa, Artificial Sequence
  Description of Artificial Sequence: Synthetic peptide
PAAKRVKLD

SEQ ID NO: 8 - protein, 11 aa, Artificial Sequence
  Description of Artificial Sequence: Synthetic peptide
RQRRNELKRSP

SEQ ID NO: 9 - protein, 38 aa, Artificial Sequence
  Description of Artificial Sequence: Synthetic polypeptide
NQSSNFGPMKGGNFGGRSSGPYGGGGQYFAKPRNQGGY

SEQ ID NO: 10 - protein, 42 aa, Artificial Sequence
  Description of Artificial Sequence: Synthetic polypeptide
RMRIZFKNKGKDTAELRRRRVEVSVELRKAKKDEQILKRRNV

SEQ ID NO: 11 - protein, 8 aa, Artificial Sequence
  Description of Artificial Sequence: Synthetic peptide
VSRKRPRP

SEQ ID NO: 12 - protein, 8 aa, Artificial Sequence
  Description of Artificial Sequence: Synthetic peptide
PPKKARED

SEQ ID NO: 13 - protein, 8 aa, Artificial Sequence
  Description of Artificial Sequence: Synthetic peptide
PQPKKKPL

SEQ ID NO: 14 - protein, 12 aa, Artificial Sequence
  Description of Artificial Sequence: Synthetic peptide
SALIKKKKKMAP

SEQ ID NO: 15 - protein, 5 aa, Artificial Sequence
  Description of Artificial Sequence: Synthetic peptide
DRLRR

SEQ ID NO: 16 - protein, 7 aa, Artificial Sequence
  Description of Artificial Sequence: Synthetic peptide
PKQKKRK

SEQ ID NO: 17 - protein, 10 aa, Artificial Sequence
  Description of Artificial Sequence: Synthetic peptide
RKLKKKIKKL

SEQ ID NO: 18 - protein, 10 aa, Artificial Sequence
  Description of Artificial Sequence: Synthetic peptide
REKKKFLKRR

SEQ ID NO: 19 - protein, 20 aa, Artificial Sequence
  Description of Artificial Sequence: Synthetic peptide
KRKGDEVDGVDEVAKKKSKK

SEQ ID NO: 20 - protein, 17 aa, Artificial Sequence
  Description of Artificial Sequence: Synthetic peptide
RKCLQAGMNLEARKTKK

SEQ ID NO: 21 - protein, 9 aa, Artificial Sequence
  Description of Artificial Sequence: Synthetic peptide
PAAKKKKLD

SEQ ID NO: 22 - DNA, 3792 bp, Artificial Sequence
  Description of Artificial Sequence: Synthetic polynucleotide
atgaacaacggcacaaataattttcagaacttcatcgggatctcaagtttgcagaaaacgctgcgcaatgctctgatccccacggaaaccacgcaacagttcatcgtcaagaacggaataattaaagaagatgagttacgtggcgagaaccgccagattctgaaagatatcatggatgactactaccgcggattcatctctgagactctgagttctattgatgacatagattggactagcctgttcgaaaaaatggaaattcagctgaaaaatggtgataataaagataccttaattaaggaacagacagagtatcggaaagcaatccataaaaaatttgcgaacgacgatcggtttaagaacatgtttagcgccaaactgattagtgacatattacctgaatttgtcatccacaacaataattattcggcatcagagaaagaggaaaaaacccaggtgataaaattgttttcgcgctttgcgactagctttaaagattacttcaagaaccgtgcaaattgcttttcagcggacgatatttcatcaagcagctgccatcgcatcgtcaacgacaatgcagagatattcttttcaaatgcgctggtctaccgccggatcgtaaaatcgctgagcaatgacgatatcaacaaaatttcgggcgatatgaaagattcattaaaagaaatgagtctggaagaaatatattcttacgagaagtatggggaatttattacccaggaaggcattagcttctataatgatatctgtgggaaagtgaattcttttatgaacctgtattgtcagaaaaataaagaaaacaaaaatttatacaaacttcagaaacttcacaaacagattctatgcattgcggacactagctatgaggtcccgtataaatttgaaagtgacgaggaagtgtaccaatcagttaacggcttccttgataacattagcagcaaacatatagtcgaaagattacgcaaaatcggcgataactataacggctacaacctggataaaatttatatcgtgtccaaattttacgagagcgttagccaaaaaacctaccgcgactgggaaacaattaataccgccctcgaaattcattacaataatatcttgccgggtaacggtaaaagtaaagccgacaaagtaaaaaaagcggttaagaatgatttacagaaatccatcaccgaaataaatgaactagtgtcaaactataagctgtgcagtgacgacaacatcaaagcggagacttatatacatgagattagccatatcttgaataactttgaagcacaggaattgaaatacaatccggaaattcacctagttgaatccgagctcaaagcgagtgagcttaaaaacgtgctggacgtgatcatgaatgcgtttcattggtgttcggtttttatgactgaggaacttgttgataaagacaacaatttttatgcggaactggaggagatttacgatgaaatttatccagtaattagtctgtacaacctggttcgtaactacgttacccagaaaccgtacagcacgaaaaagattaaattgaactttggaataccgacgttagcagacggttggtcaaagtccaaagagtattctaataacgctatcatactgatgcgcgacaatctgtattatctgggcatctttaatgcgaagaataaaccggacaagaagattatcgagggtaatacgtcagaaaataagggtgactacaaaaagatgatttataatttgctcccgggtcccaacaaaatgatcccgaaagttttcttgagcagcaagacgggggtggaaacgtataaaccgagcgcctatatcctagaggggtataaacagaataaacatatcaagtcttcaaaagactttgatatcactttctgtcatgatctgatcgactacttcaaaaactgtattgcaattcatcccgagtggaaaaacttcggttttgattttagcgacaccagtacttatgaagacatttccgggttttatcgtgaggtagagttacaaggttacaagattgattggacatacattagcgaaaaagacattgatctgctgcaggaaaaaggtcaactgtatctgttccagatatataacaaagatttttcgaaaaaatcaaccgggaatgacaaccttcacaccatgtacctgaaaaatcttttctcagaagaaaatcttaaggatatcgtcctgaaacttaacggcgaagcggaaatcttcttcaggaagagcagcataaagaacccaatcattcataaaaaaggctcgattttagtcaaccgtacctacgaagcagaagaaaaagaccagtttggcaacattcaaattgtgcgtaaaaatattccggaaaacatttatcaggagctgtacaaatacttcaacgataaaagcgacaaagagctgtctgatgaagcagccaaactgaagaatgtagtgggacaccacgaggcagcgacgaatatagtcaaggactatcgctacacgtatgataaatacttccttcatatgcctattacgatcaatttcaaagccaataaaacgggttttattaatgataggatcttacagtatatcgctaaagaaaaagacttacatgtgatcggcattgatcggggcgagcgtaacctgatctacgtgtccgtgattgatacttgtggtaatatagttgaacagaaaagctttaacattgtaaacggctacgactatcagataaaactgaaacaacaggagggcgctagacagattgcgcggaaagaatggaaagaaattggtaaaattaaagagatcaaagagggctacctgagcttagtaatccacgagatctctaaaatggtaatcaaatacaatgcaattatagcgatggaggatttgtcttatggttttaaaaaagggcgctttaaggtcgaacggcaagtttaccagaaatttgaaaccatgctcatcaataaactcaactatctggtatttaaagatatttcgattaccgagaatggcggtctcctgaaaggttatcagctgacatacattcctgataaacttaaaaacgtgggtcatcagtgcggctgcattttttatgtgcctgctgcatacacgagcaaaattgatccgaccaccggctttgtgaatatctttaaatttaaagacctgacagtggacgcaaaacgtgaattcattaaaaaatttgactcaattcgttatgacagtgaaaaaaatctgttctgctttacatttgactacaataactttattacgcaaaacacggtcatgagcaaatcatcgtggagtgtgtatacatacggcgtgcgcatcaaacgtcgctttgtgaacggccgcttctcaaacgaaagtgataccattgacataaccaaagatatggagaaaacgttggaaatgacggacattaactggcgcgatggccacgatcttcgtcaagacattatagattatgaaattgttcagcacatattcgaaattttccgtttaacagtgcaaatgcgtaactccttgtctgaactggaggaccgtgattacgatcgtctcatttcacctgtactgaacgaaaataacattttttatgacagcgcgaaagcgggggatgcacttcctaaggatgccgatgcaaatggtgcgtattgtattgcattaaaagggttatatgaaattaaacaaattaccgaaaattggaaagaagatggtaaattttcgcgcgataaactcaaaatcagcaataaagattggttcgactttatccagaataagcgctatctctaa

SEQ ID NO: 23 - DNA, 3788 bp, Artificial Sequence
  Description of Artificial Sequence: Synthetic polynucleotide
atgaacaacggaacaaataattttcagaactttattgggatcagttcgcttcagaaaacgcttcgtaatgctctgattcccacagaaaccactcagcagtttatcgtaaagaatggcattatcaaggaggatgaattacgcggcgagaaccgccaaatcttaaaagatatcatggacgactactaccgcggtttcattagcgaaactcttagttcaattgacgacattgactggacgtccttgttcgaaaagatggagattcaattaaagaacggtgataacaaggatacgttgattaaagaacagacggagtaccgtaaggctatccacaaaaaatttgcaaacgacgaccgctttaaaaatatgtttagcgcaaaattaatctccgacatcctgcctgaattcgtcatccataacaataactatagcgcctcggaaaaagaagaaaaaacgcaggttattaaacttttctcgcgctttgcaacaagctttaaggattacttcaaaaatcgcgccaattgtttttcagccgacgacattagctccagttcctgccaccgtattgtgaatgacaacgctgagatttttttttccaatgcgctggtttatcgtcgtattgttaagagccttagtaacgacgacattaataaaattagcggtgatatgaaggatagcttgaaagaaatgagtctggaagagatctatagttacgagaagtacggcgaatttattacccaggagggcatttcattttacaatgatatctgtggaaaagtcaactcctttatgaacttgtattgccaaaagaataaagaaaacaaaaacctgtacaaactgcaaaagttacacaagcagattttgtgtatcgcagacacgtcatacgaagtaccgtacaagtttgagtccgatgaagaagtgtaccaaagcgttaatggctttttggataacatttcgagcaaacatatcgtagagcgtttgcgtaagattggtgataattacaacggttacaatttagacaaaatctatatcgtctctaagttttacgaaagtgtttctcagaaaacttaccgcgattgggagacgatcaacactgcgctggagattcattacaataatatccttccaggtaacggtaaaagcaaagctgataaggtgaaaaaggcggttaaaaatgaccttcaaaagtctatcacagaaatcaacgaattggtcagcaattataagctttgcagtgacgataacattaaggccgagacttacatccatgagatctctcacattcttaataattttgaagcgcaagagctgaaatacaatcctgaaatccatctggtcgaaagtgaattaaaagcctccgaattaaaaaatgtcttggacgtgatcatgaatgcgttccattggtgctcagtttttatgacggaagagttggtggacaaagacaacaatttttacgccgagcttgaggaaatttacgacgaaatttaccccgttatttcgttatacaaccttgtgcgtaattacgttacacaaaagccctattcgacaaagaaaatcaagttaaatttcgggattcccacattagctgatggatggtccaaatccaaagaatactcgaataacgctatcatccttatgcgtgataatttgtactacttaggcatcttcaatgcgaagaacaaacctgacaagaaaattatcgaaggaaacacttcggagaacaaaggtgattataaaaagatgatctacaacttgcttcccgggccaaacaaaatgattcccaaggtatttttgagttctaaaaccggtgtcgaaacttacaaaccaagtgcttatattttggaaggatacaaacagaacaaacatatcaagtcttcgaaagacttcgatattacgttctgccacgatctgatcgattacttcaagaactgtattgctattcaccccgagtggaagaactttggatttgatttctccgacacgtccacttatgaagatatctctggcttctatcgcgaggttgaattacaagggtataagattgactggacttatatttcggagaaggatatcgatcttttgcaagaaaaagggcaactttatttatttcagatctataacaaggacttttcaaaaaagagcactggaaatgacaatctgcataccatgtaccttaagaacctgttctcggaagagaacctgaaggacattgtacttaaactgaatggagaggcagagatcttctttcgcaaatcaagcattaagaacccaattattcacaaaaaggggagtatcttagtaaatcgcacatatgaggctgaggaaaaagatcagtttggtaacattcagatcgtgcgtaagaacattcctgaaaatatctatcaggaactttataagtatttcaacgataaaagtgataaagagctgagtgacgaagcggctaaacttaagaatgttgtgggacaccatgaggcagcaaccaatattgtgaaggattatcgctatacgtacgacaaatactttttacacatgcccatcactattaattttaaagctaataagactggcttcattaacgatcgcatcctgcagtacattgctaaggaaaaggatcttcacgttatcggtatcgatcgcggggagcgtaatcttatctacgtctctgtcattgacacgtgtggcaatattgtggagcaaaagtccttcaatattgttaacggctatgactatcagattaaattgaaacagcaggaaggtgcgcgtcagattgcccgcaaggaatggaaggaaattggcaagatcaaagaaattaaggagggctacttaagcttagtaattcacgaaattagtaaaatggttatcaaatacaacgccatcatcgcgatggaggatctttcgtacgggtttaagaaaggtcgttttaaagtggagcgtcaggtgtaccagaaatttgaaactatgcttattaacaaacttaactacctggttttcaaggatatcagtattactgaaaacggggggctgttaaaagggtatcaattaacttacattccagacaaattaaagaacgttggacatcagtgtggctgcattttttatgtaccagctgcatacacttcaaagatcgatcctacgactgggttcgtgaacatttttaagtttaaagacttgacggtagatgccaagcgcgaattcatcaagaaattcgacagcattcgctacgactctgagaaaaatcttttctgtttcacattcgattataacaatttcattacgcagaacacagtaatgtccaagtcttcttggagtgtttatacatatggtgtccgcattaagcgccgtttcgtcaacggccgcttcagtaatgagagcgatactattgacatcacaaaagacatggaaaaaacactggaaatgaccgacatcaattggcgtgacggccatgacttacgtcaggatatcattgattatgagatcgttcaacacatcttcgaaatctttcgcttgactgttcaaatgcgcaattccttgtcggaattggaggaccgtgattatgaccgcttaatttcccccgtcttaaatgaaaacaatattttttatgactctgcaaaagctggagatgctctgccgaaagacgccgatgcaaatggggcatattgcattgctttaaaggggctttacgagatcaagcaaatcaccgaaaactggaaagaggatggaaagttttcgcgtgataaactgaagatctctaacaaagactggttcgactttatccagaacaagcgttattt

SEQ ID NO: 24 - DNA, 3789 bp, Artificial Sequence
  Description of Artificial Sequence: Synthetic polynucleotide
atgaacaacggcaccaataacttccaaaacttcatcgggatctctagccttcagaagacgcttcgcaatgctcttatcccaactgagaccactcaacaatttattgtgaagaatggaattattaaagaggacgaactgcgtggcgagaatcgtcagatcttaaaggacattatggatgattattaccgtggattcatctccgaaacattatcgtcgatcgatgatatcgattggacttctctgttcgagaaaatggaaattcaattgaaaaacggagataataaagatacgcttatcaaagaacagacggaatatcgtaaagcgattcataagaaattcgcaaatgacgatcgtttcaaaaatatgttcagtgccaagcttatttcggacattttacctgaatttgtaattcataataataactactcagcaagtgagaaggaggagaaaacccaagttattaaactgttctctcgtttcgcaacgtcctttaaagattactttaaaaaccgcgcgaattgctttagcgctgacgacatttccagctcatcctgtcatcgcatcgtaaacgacaatgcggaaatcttcttcagcaacgccctggtttaccgccgcatcgtcaaaagcttatcgaatgacgacatcaataagatctcaggagatatgaaggactcgcttaaggagatgtctctggaggaaatttatagttacgaaaagtatggagagttcattacccaggagggaatctcgttctacaatgacatttgcgggaaggtgaactccttcatgaacttatactgccagaaaaacaaagagaacaaaaatctgtataaattgcagaaattacataaacagattctttgtattgctgacacttcctacgaagtaccctataaattcgagtcagatgaagaagtataccagtccgtgaacggatttctggacaatatctcctcaaaacacatcgtggaacgcttacgtaaaattggcgataattataatggttacaatcttgacaaaatttatatcgtatctaaattttacgagagtgtgagccaaaagacctaccgcgactgggagaccatcaacacagctttagaaattcactataataatatcttacccggcaatggtaagagcaaggctgacaaggtaaaaaaggccgtcaagaatgatttgcagaaatctattacagaaattaatgagttagtctccaactataagctttgttccgacgataacatcaaagctgagacatatattcatgagattagtcacattcttaacaacttcgaggcccaggaacttaagtacaatcctgaaattcatcttgtcgagtctgagctgaaagctagtgaattgaaaaatgttttagacgttattatgaacgcattccactggtgctctgtgtttatgacagaagaactggtcgacaaggacaataacttctatgccgaacttgaggaaatctacgatgaaatttaccctgtaatctccttgtataatcttgtacgtaattacgtcactcaaaaaccttacagcacgaaaaaaattaaattgaacttcgggattcctacacttgccgacgggtggtctaaatccaaggaatatagcaacaatgccattattttaatgcgcgacaatctttactatttaggaatttttaacgctaagaacaagcccgataaaaagattattgaaggaaacacgtctgaaaataagggcgactacaaaaagatgatttataaccttttgcccggtccaaacaaaatgatcccaaaggtattcctgtcatccaaaacaggggttgagacatataagcccagcgcatatattctggaaggatacaaacagaataaacatatcaaaagcagcaaagattttgacattactttttgccacgatttaatcgactacttcaaaaactgtatcgctatccaccctgaatggaagaatttcggatttgatttctcagatacaagtacgtatgaggatatcagcggtttctatcgcgaagttgaacttcaagggtataaaattgactggacctacattagtgagaaggacatcgacctgttacaggaaaaaggccaattgtacttgtttcagatctacaataaggatttctcaaaaaaatcgaccggcaatgataacttgcacaccatgtacctgaagaaccttttttcggaggaaaaccttaaagacattgtcctgaagttgaatggagaagcggagattttctttcgtaagtcttccattaaaaatccaattattcataagaagggcagcatccttgtgaaccgtacgtacgaggcggaagagaaggaccaattcggtaacattcaaatcgtccgcaagaacatccctgaaaatatttatcaggagctttacaagtatttcaatgataagtccgacaaggaattatcagatgaggctgcgaagttgaaaaatgttgttggtcatcacgaggcggcgacgaatattgtaaaggattatcgctacacttatgacaagtactttctgcacatgccgatcaccattaatttcaaggcgaacaaaacaggatttattaatgaccgcatcttacaatacattgccaaagaaaaggacttacacgttattggcattgatcgtggagaacgcaacttaatctacgtaagcgttattgacacttgcgggaatatcgtagaacaaaagagcttcaacatcgtgaatggttacgattaccagatcaagcttaagcagcaggagggagcgcgccagatcgcgcgcaaggaatggaaggagattggtaagatcaaggaaatcaaggaaggttatctgtccttggtaatccacgaaatttcgaaaatggttatcaaatacaatgctattattgcaatggaggacttgtcctacggctttaaaaaaggacgctttaaggtggagcgccaggtttatcaaaagtttgaaacaatgctgattaacaagctgaactatttggtctttaaagatatctccatcaccgaaaatggtgggcttttgaaaggctatcaacttacatatatccctgataagcttaagaatgtgggtcatcagtgcgggtgcattttttatgttcctgcagcctacacgtccaaaatcgatcctacaactggatttgttaatatcttcaaatttaaggatcttaccgtcgacgcgaagcgcgaatttatcaagaaattcgatagtattcgttatgattccgaaaaaaaccttttctgtttcacctttgattataataactttatcacgcaaaatactgtcatgagcaaatcgagttggtctgtgtacacttacggagtacgcatcaagcgtcgttttgttaatgggcgcttcagtaacgagtcagacacgattgatatcacaaaagatatggagaaaacgctggagatgacagacatcaattggcgcgatggtcatgacttacgtcaagacattatcgattatgaaattgtccagcatatctttgagatctttcgtttgactgttcagatgcgcaacagcctgtcagaattggaggatcgtgactatgatcgccttatttctcccgtcttaaatgagaacaatatcttctacgactcagccaaggctggagatgcactgccaaaagacgccgacgcaaatggggcctactgtattgcattgaaggggttgtacgagatcaaacagattacagaaaattggaaggaggacggtaagttctctcgtgataagctgaagatttctaacaaagactggttcgatttcattcagaacaaacgttacctg

SEQ ID NO: 25 - DNA, 3789 bp, Artificial Sequence
  Description of Artificial Sequence: Synthetic polynucleotide
atgaacaacggtaccaataactttcagaatttcattggaatcagcagcttacagaaaaccctgcgcaatgcacttatccccactgagacaacccagcagttcattgtaaagaacgggattattaaagaagatgagcttcgcggggagaatcgtcagatcttaaaggatattatggacgattactaccgtggcttcatttcggagacgctgtcgtcgatcgacgacatcgactggacatccttgtttgaaaagatggaaatccaactgaagaatggcgataacaaggacacgttaatcaaagagcagacggaataccgtaaagctatccacaaaaagttcgctaatgacgaccgctttaagaacatgttctcagcaaaacttattagcgatattttacctgaatttgtcatccacaataacaattactccgcgagtgaaaaagaggagaaaacccaggtgattaagctgttttcccgttttgcaaccagtttcaaggactattttaagaatcgtgctaattgtttctctgcagacgacatttcctcgtcgtcctgccatcgcattgttaatgataatgctgaaatctttttttcaaacgcacttgtgtatcgtcgcattgtcaaaagcttaagtaatgacgatatcaataagatctcaggagacatgaaggactccctgaaagaaatgtcattggaagaaatttactcttatgaaaagtatggagaatttattacgcaggagggtatcagcttctataacgacatttgtggtaaagtgaacagctttatgaatctttattgtcaaaagaataaagagaacaaaaatctgtacaagctgcagaaattgcataaacaaattctgtgcattgcagatacttcgtatgaggttccttacaaattcgagtcggatgaggaggtgtatcaaagcgtaaacggatttttggataacattagtagtaagcatattgtggaacgccttcgcaagattggtgacaactataacggatacaacttagacaagatctatattgtctcgaagttttacgaaagtgtttcccaaaagacttatcgcgactgggagacaatcaacactgcgctggaaattcactataacaatatcttgccggggaacggaaaaagtaaggcagataaggtgaagaaagcagtcaaaaatgatctgcaaaaaagcattactgaaattaacgaacttgtgtcaaattacaaattgtgttcggatgacaatattaaagcggaaacgtatatccacgagatctcgcacattcttaataatttcgaggcgcaggaattaaagtataatcctgagatccatttggtggaatcagaacttaaagctagtgaactgaaaaatgtcctggacgttattatgaatgcatttcactggtgttctgtctttatgacagaagaacttgtcgacaaagacaacaacttttatgcggaattagaagagatttacgacgaaatttatcccgttatttcgttatataatttagttcgtaattacgtgactcagaaaccctacagcacaaaaaagattaaattaaactttgggattccgactcttgctgatggatggagcaagtccaaggagtactctaataacgccattatcttgatgcgtgacaacctgtactacctgggcatttttaacgctaaaaacaaacccgacaaaaagatcattgaagggaacacctcggaaaataagggggactataaaaaaatgatctacaatctgttgccaggcccaaataagatgatcccaaaggtttttttatcttccaaaactggcgtagaaacttacaagccgagcgcatacatccttgaaggatataaacaaaacaaacatatcaaaagttcaaaggacttcgatattacgttctgccatgatttaatcgattatttcaagaattgcatcgcgattcacccagagtggaaaaactttgggtttgatttttcagacaccagcacttacgaggatattagtggattctatcgtgaggttgaactgcagggctataaaattgactggacctatatttctgaaaaagatattgatctgcttcaggagaaaggccaattgtacttatttcaaatctataacaaggatttctccaagaagtccacgggtaatgacaacttacacacaatgtatctgaagaatctgtttagtgaggagaacttgaaggacattgtgctgaagcttaatggcgaggccgaaatcttttttcgtaagtcctccattaaaaaccctattatccataagaaagggagtattcttgtcaaccgcacgtatgaggccgaagaaaaggaccaattcggaaacatccaaattgtccgtaaaaatattcctgagaacatttaccaggagctttacaagtatttcaacgacaagagtgataaagaactttcagatgaggcggcgaaactgaagaatgtagtggggcaccacgaagctgccacgaatattgtaaaggattaccgttacacctacgacaagtactttttgcatatgcccatcacaattaattttaaggccaataaaactggttttatcaacgatcgtatcttacagtacattgctaaggaaaaagatctgcacgttatcggtatcgatcgcggggaacgcaatctgatttatgttagtgtgattgacacgtgcggaaatattgttgagcagaagagctttaatatcgtaaatggatatgactatcaaattaaactgaagcaacaggaaggggcccgccagattgcccgcaaggagtggaaagaaattggaaagatcaaggagattaaagaagggtacctttcccttgttatccacgaaatctcgaaaatggtgatcaagtacaatgccattattgctatggaggatctgtcatatgggtttaagaaaggccgctttaaggtggaacgtcaggtttaccagaagtttgagaccatgcttatcaataagctgaattatcttgtcttcaaagacatctcaatcacagagaacggcgggctgttaaaaggatatcagctgacctatatccccgacaaactgaaaaatgtcgggcaccaatgcggctgtattttctacgtgcccgctgcatacacatctaaaattgacccaacgactggattcgtaaatatttttaagtttaaggatcttacggtagatgcaaagcgcgaatttatcaagaaatttgatagtatccgttacgacagcgagaaaaacttattttgttttacgttcgattataacaacttcatcacgcaaaataccgtcatgtcaaaatcttcctggtcagtctatacgtatggcgtccgtatcaagcgccgcttcgtcaacgggcgtttttcaaacgagtcagataccatcgatatcaccaaagatatggaaaaaacattggagatgacggacatcaattggcgcgatggtcatgacttacgccaggacattattgactacgaaatcgtacaacatatttttgagattttccgtctgaccgtgcaaatgcgcaactcattatccgaacttgaggatcgtgattacgaccgcttgatcagtcctgttctgaacgagaataatattttttacgacagtgccaaggcgggagacgcactgcccaaggacgctgacgctaacggagcttattgtattgcgttgaagggactttacgaaatcaagcaaatcactgaaaactggaaggaggatggtaaattctcacgcgacaagttgaaaatttcgaacaaggactggttcgatttcatccaaaacaagcgttattta

SEQ ID NO: 26 - DNA, 3789 bp, Artificial Sequence
  Description of Artificial Sequence: Synthetic polynucleotide
atgaacaacgggactaataacttccagaacttcatcggtatttcatcattacaaaaaacgcttcgtaacgccttgatcccaacagaaacgacccaacaatttattgtaaaaaacggcatcatcaaagaagacgaactgcgtggcgaaaatcgccaaattttgaaggacattatggatgactattatcgtgggtttatctcggagacattatcctccatcgacgacattgattggacgagtctttttgagaaaatggagatccagcttaaaaatggtgataacaaggatacattgatcaaggagcaaaccgagtaccgcaaggccatccataagaagttcgcaaatgacgaccgcttcaaaaatatgtttagtgccaaattgatctcggatatccttcctgagttcgtaattcacaacaataattatagcgcatccgaaaaggaggaaaagactcaagtcattaagcttttcagtcgctttgctacctcgtttaaggactatttcaagaaccgcgcgaactgcttctcagcggatgacatttcttcctcgtcgtgtcaccgcatcgtgaatgataatgcggagatcttctttagtaatgccttggtataccgccgcattgttaaatccctgtctaacgacgatatcaataagatctcaggagatatgaaggatagccttaaagaaatgtctctggaagaaatttactcctatgaaaagtacggtgagtttatcacccaagaggggattagcttttataacgatatctgcgggaaggtgaattcgtttatgaacctttattgtcaaaagaataaggagaataagaacttatataagcttcagaaactgcataaacaaatcttatgcattgccgatactagctatgaagttccgtataaattcgagagcgatgaagaagtttatcagagcgtcaatgggttcttggataacatttcatcaaaacacatcgtggaacgtctgcgtaagattggggataactacaacggatataatcttgacaaaatttatattgtatctaaattctatgagtcggtgagtcaaaagacctaccgtgattgggaaacaatcaataccgcgttagaaatccactataacaacattctgccagggaatggtaaaagtaaagcggacaaagtcaagaaggctgtgaagaacgatctgcaaaagagtattacagagattaacgaattagtctccaattataagttatgctcggacgataacattaaggcggagacgtatattcatgagatttcgcatattcttaacaacttcgaggcacaagagcttaagtataacccagagattcaccttgtcgaatcggagctgaaggcatcggaattaaaaaatgtcttagatgtaatcatgaacgcgttccattggtgcagtgttttcatgactgaggagttagttgacaaggacaataacttctacgcagaattagaagagatctatgatgagatttatccagtgatttcgctgtataatctggtacgtaattacgtcactcaaaagccctactcaacaaaaaaaattaagctgaacttcggaattccgactctggccgacgggtggtccaagtcaaaggagtattctaataatgctatcatcctgatgcgcgataacttatactatttgggaattttcaatgccaaaaataaaccagataaaaagattatcgaaggtaatacaagcgagaataagggtgactataagaaaatgatttacaatcttcttccaggccctaacaagatgattcccaaagtttttttgtccagtaaaacaggggtcgaaacttacaagcccagtgcctatatccttgaagggtacaagcagaataagcacatcaaatcctcgaaagactttgatattacattttgtcatgacttaatcgattattttaagaactgtatcgcaatccatccagaatggaagaacttcgggtttgatttctctgatacttccacgtatgaggatatttccgggttctaccgcgaagtagagcttcagggctataaaattgactggacatatatttcagaaaaagacatcgatctgttacaagaaaaaggacagttgtatctgtttcaaatctataataaggatttctccaaaaagtcaactggaaatgataacttacatacaatgtatctgaaaaatctttttagtgaagagaatttgaaggatatcgtgctgaagttaaatggcgaagcagagatcttcttccgcaagtcctcgatcaagaatcctatcatccacaagaaaggtagtattctggttaaccgcacgtacgaggccgaggaaaaagaccagttcggtaatatccagattgtacgtaagaatattcctgaaaatatttaccaggaattatacaagtattttaacgacaaatcggataaggagctttcagatgaggccgcaaagttgaagaacgtcgtaggacaccatgaggccgctacgaatatcgtcaaggactaccgctatacgtatgacaagtacttcctgcacatgcctattactatcaatttcaaagctaataaaacaggattcatcaatgatcgtatccttcagtacattgccaaagaaaaagatctgcacgtaatcggaatcgaccgtggcgaacgtaatctgatttacgtatcagttatcgacacatgtggtaacatcgtggagcagaaatcttttaacattgttaacggctatgattatcagattaagcttaaacagcaggagggggcacgccaaatcgctcgtaaagaatggaaggagattggaaagattaaagagattaaagaggggtacctttcgctggttattcacgaaatttccaagatggtgattaagtacaatgcaatcatcgcgatggaagatcttagttacggattcaaaaagggacgcttcaaagttgagcgtcaggtctaccagaaatttgaaacgatgctgattaacaaattgaattacttggtattcaaagatatctcaattactgaaaatggtggcttattaaagggttaccagcttacctatatcccggataagctgaagaacgtgggccatcaatgcggctgcatcttttacgtccctgccgcatatacctctaaaattgaccccaccaccggattcgtaaatatttttaaattcaaggacctgacggtggacgccaagcgcgaattcatcaaaaaattcgactcaatccgctatgattccgaaaaaaatcttttctgctttacgttcgattataataacttcattacccaaaacacggtgatgtcaaaatcgtcctggagcgtgtatacttatggagtgcgtatcaagcgccgctttgttaatgggcgcttcagtaacgaaagcgataccatcgacattaccaaagacatggagaagacgcttgaaatgacggatatcaattggcgtgacggacacgatcttcgtcaggatatcatcgactacgagattgtgcaacatatctttgagattttccgtttaactgttcaaatgcgtaactccttgtccgaattggaagaccgtgattacgaccgcttgatttcaccagtgcttaacgagaataacatcttctacgactccgccaaagcaggcgatgccctgccaaaggacgctgatgcaaatggtgcatactgtatcgcgttgaagggcttatacgagattaagcaaatcaccgaaaattggaaagaggatggaaagttcagtcgcgataagctgaagatctctaataaagattggtttgactttatccagaacaaacgttattta

SEQ ID NO: 27 - DNA, 3789 bp, Artificial Sequence
  Description of Artificial Sequence: Synthetic polynucleotide
atgaacaacggtaccaataatttccaaaatttcatcggaatctcatccttgcaaaaaaccttgcgcaatgctttgatccccaccgaaaccacgcagcagttcatcgtgaaaaacggcattatcaaagaggatgagttgcgcggggaaaaccgtcaaattcttaaggatatcatggacgattactaccgtgggtttatcagtgagaccctgtcaagcattgacgacattgactggaccagcttatttgagaagatggagattcaattaaagaacggggacaataaggacacgcttatcaaagagcagacagaataccgtaaagcgattcataagaaatttgcaaatgacgatcgcttcaagaacatgttttcagcaaaattaatcagcgacatccttcccgaatttgtgattcataataacaactattcggctagcgaaaaagaggagaaaactcaggttattaagcttttctcgcgttttgccacttcgttcaaagactattttaagaatcgcgcaaactgcttttcggctgatgatatttccagttctagctgccatcgtatcgttaacgataatgctgagattttcttctctaatgccctggtgtatcgtcgtatcgttaaatctttgagcaacgacgatattaataagatttcaggcgacatgaaggattctttaaaggagatgtctttagaagagatttattcctatgagaaatatggcgagtttatcacccaagaaggaatttcgttctacaacgacatctgtggcaaagtgaacagcttcatgaatttatactgccaaaagaataaggagaataaaaatttatataaactgcagaaactgcataagcaaattctttgcattgcagacacctcttatgaagttccttataagtttgaatcggacgaggaggtatatcagagtgtgaacgggttcctggacaatatttcatccaagcatattgttgaacgtttacgcaaaattggagacaattacaatgggtataaccttgacaaaatttacatcgtgtcgaagttttacgaatcggtaagccagaagacctatcgtgactgggaaactatcaataccgccttagaaattcattacaacaatattcttcctggtaacggcaaaagcaaagccgataaggtaaagaaggctgtcaagaacgacctgcaaaagtctatcacagagatcaacgagttagtctctaactacaaattatgttccgacgacaatattaaagccgaaacctacatccatgagatctcacacattcttaacaattttgaggcccaggagctgaaatataacccagaaattcaccttgtagagagcgaattaaaagcctccgagctgaagaacgttttggatgtaatcatgaacgcatttcattggtgcagcgtatttatgacagaggagttggtcgacaaggacaataacttttacgccgagcttgaagaaatctacgatgaaatttacccggtaattagtttatataatttagttcgcaactacgtaactcagaaaccctacagtaccaagaagattaaattgaactttgggatcccgacacttgctgacggttggagtaaatcaaaagaatactccaataatgcaattatcctgatgcgcgacaatctttactacttggggatctttaacgcaaagaacaaaccagataagaaaatcatcgagggcaacaccagcgagaataaaggcgattacaagaaaatgatctataatcttttgccgggaccgaacaaaatgatcccaaaggttttcctgtcgtcgaaaacgggagtcgagacatataaaccatctgcgtacatcttggaaggttacaaacagaataagcatattaagtctagtaaagacttcgacatcaccttttgtcatgacctgattgattatttcaagaactgtattgctatccatccagaatggaaaaacttcggatttgacttctccgatactagcacctacgaagacatttcgggtttttatcgcgaagtagagcttcaagggtacaaaattgattggacatatattagcgagaaagacattgatttgcttcaagagaagggacagttatatttattccagatctacaacaaagacttctcgaagaaatccaccggtaatgataatcttcacactatgtacctgaagaatttattttcagaggaaaatctgaaggacattgtacttaaacttaatggagaagccgaaatcttcttccgcaagagttccattaaaaatccgattattcataaaaagggaagtatccttgtgaaccgcacgtatgaggccgaagagaaggatcagtttgggaatattcaaattgtccgcaaaaacatccccgagaacatctaccaggaactgtataaatactttaatgataaatctgataaagagttatcagacgaggctgccaaactgaaaaacgtagtcggtcatcatgaggcagcgaccaatattgtaaaggactaccgttacacctacgacaagtatttccttcacatgccgatcacgattaattttaaggctaacaagaccggctttatcaatgaccgcatcttgcagtacatcgcgaaagagaaagatttacacgtcatcggaattgatcgtggagagcgtaatcttatctacgtcagcgtcatcgacacctgtggaaacattgtggaacaaaaaagttttaatatcgtaaacggctacgactatcaaattaaacttaaacagcaagagggagctcgccagatcgctcgcaaagagtggaaagagattgggaaaattaaagaaattaaagagggttacctgtcgctggtaattcacgaaatctcgaaaatggtcatcaaatataatgcaattatcgctatggaggatctgtcctacgggttcaagaagggacgttttaaagtagagcgccaggtgtatcaaaaattcgaaaccatgttgatcaataagcttaactatttggtcttcaaagatatttcgattacggagaacggaggtttgttgaaaggatatcagctgacgtatatcccagacaagttgaaaaacgtggggcatcaatgtggatgtattttctatgtgcccgcggcctacacgagtaagatcgatcctaccactggtttcgtcaacattttcaaatttaaagatcttaccgtggatgcgaagcgcgaatttattaagaaatttgatagcattcgctatgattccgaaaagaacctgttctgttttacgttcgactataacaatttcattacccaaaacacggtgatgagcaaatcctcttggtcagtttatacatacggtgtacgtatcaaacgccgtttcgttaacggacgcttttccaatgagtctgatacaatcgatatcacgaaagatatggaaaaaacattagagatgactgatatcaactggcgtgacgggcacgacctgcgtcaagacattattgactacgagattgtgcagcatatcttcgaaatctttcgcttaactgtgcaaatgcgtaactcgttatccgagttagaagaccgtgactacgatcgcctgatttcacccgtcttgaacgaaaataacatcttctacgattccgcgaaggctggggacgcattgcccaaggacgcagacgcgaatggagcgtactgtattgcgcttaaaggattatatgaaatcaagcagatcaccgaaaattggaaggaggacgggaagttctcacgcgacaaactgaagatttcaaataaggactggttcgatttcattcagaataagcgttacctg

SEQ ID NO: 28 - DNA, 3788 bp, Artificial Sequence
  Description of Artificial Sequence: Synthetic polynucleotide
tgaataatggtacgaacaactttcagaacttcatcggcatctccagccttcaaaagactttacgcaacgcattgattcccacggagactacgcaacagtttatcgtaaaaaatggtattatcaaagaagatgaattacgcggggagaatcgccagattcttaaggacattatggacgattattaccgtggattcatcagtgagacactgagctccattgatgacatcgactggacgtcattgtttgaaaagatggaaatccagttgaaaaatggcgataacaaagatacattgattaaagagcagacagagtaccgcaaagcaattcacaagaaattcgccaatgatgatcgttttaagaacatgtttagtgccaagcttatttcggatatcttacccgaattcgtgattcacaacaacaattattcggcaagtgagaaagaggaaaagacccaggttatcaaattgttttcgcgcttcgccacttcgttcaaagattatttcaagaaccgtgcaaactgtttctccgctgacgacatcagttccagctcatgccaccgtattgtaaatgacaatgcggagatctttttcagtaatgccttagtatatcgtcgcattgtaaagagcttatctaatgatgacattaacaagatctcgggtgatatgaaggactcacttaaggagatgagtctggaagagatctactcctacgaaaaatacggggaattcatcacccaggagggaatttcattctacaacgatatctgcggcaaagttaactcctttatgaatctgtactgtcaaaagaacaaggagaataaaaacctgtataaattgcagaaacttcataaacaaattttgtgtatcgcagacacgagttatgaagtaccttataaattcgaatccgacgaagaggtatatcagtccgtaaatgggttcctggacaatatcagtagtaagcacattgtggaacgcttacgcaaaattggagacaattacaacgggtataacctggacaaaatctacatcgtatccaaattttatgaaagcgtgtctcaaaaaacttatcgtgattgggaaacaatcaacacggctcttgagatccattacaataacatcttgccgggtaacggcaaatcgaaggcagacaaagttaaaaaagcagttaagaacgacttacagaaaagcattacggagattaacgagttagtaagtaattacaaattatgctccgacgataatatcaaagctgaaacctacatccatgaaattagccacattttgaacaatttcgaagcgcaggagctgaaatataaccctgaaatccatctggtagagtctgagttgaaggcgtcagaactgaaaaacgttcttgacgtcatcatgaatgcctttcactggtgtagtgtttttatgactgaggagcttgtagataaggacaacaacttctatgctgaacttgaagagatctacgatgaaatctaccccgtaatcagtctgtataatttagttcgtaactacgtcacgcagaaaccctattcgactaagaaaattaagctgaactttgggatccctactttggcagacgggtggagcaagagtaaagaatacagtaataatgcaattatcttgatgcgcgataacttatattacttaggtattttcaatgctaagaacaaacctgataagaagattatcgaaggaaatacgagtgagaataagggagactacaaaaagatgatttacaacttgctgccagggcctaataagatgattccaaaagtttttctgtcgagcaagacaggggttgaaacttataagccatccgcttatatccttgaggggtacaagcagaataagcatatcaagtcctccaaagattttgatattacattttgccacgacttaattgattacttcaagaactgcatcgcaatccatcccgaatggaagaatttcggcttcgatttctcagatacgtccacgtatgaggatatctcaggcttttaccgcgaagttgagctgcaaggttataaaattgattggacatacatctccgaaaaagacattgatcttttacaggaaaagggccaattatacttatttcaaatctataacaaagattttagcaagaagtccacaggtaatgataacctgcatacgatgtatttgaaaaatcttttcagtgaagagaatttgaaggatatcgtcctgaagctgaacggtgaggctgagatcttcttccgcaaatcgtctatcaaaaaccccatcattcacaaaaagggaagtatcttagtaaaccgcacttatgaagcggaggaaaaggatcagttcgggaacatccagatcgtgcgcaagaacattccagaaaacatctatcaggaactttacaaatatttcaatgacaagtctgataaagaattatcagacgaggcggcgaaacttaaaaatgttgttggacaccacgaagcagcgacgaatattgtaaaggattatcgctacacatacgataaatactttttgcacatgccaatcaccattaactttaaggcgaacaagacaggtttcattaacgaccgtattctgcaatatatcgcaaaggaaaaagacctgcacgttattgggatcgatcgtggcgaacgcaatttgatctacgtaagcgttatcgacacttgcggaaatatcgttgaacaaaaaagctttaatatcgtcaatggatacgattaccaaatcaagctgaaacaacaagaaggggcacgtcagatcgctcgtaaagaatggaaagagattggtaagatcaaagagattaaagaagggtatctttctttagtaattcacgagatttcgaaaatggttattaaatacaatgcgattattgctatggaagacttaagctacggctttaagaaaggtcgcttcaaagtggagcgccaagtgtatcagaagtttgaaacgatgttgattaacaaattaaattacctggtctttaaggacatcagtatcacagaaaatggggggttgcttaaagggtaccagcttacatacatccctgataaactgaaaaatgtcggtcatcagtgcggatgtatcttctatgtaccagcagcctataccagtaagattgaccctactactggctttgtgaatatttttaaattcaaggatttaaccgtggacgccaagcgtgaatttattaaaaaatttgattcgattcgctacgacagtgagaaaaaccttttctgctttacctttgactacaacaattttattacccagaacaccgtaatgtcaaagagttcgtggtctgtatatacctacggtgttcgcatcaagcgccgcttcgtaaacgggcgtttcagtaacgaatctgacaccatcgacatcactaaagatatggagaagacattggaaatgacggacattaattggcgtgatggccatgacttacgtcaggacattattgattacgaaattgtgcagcatatcttcgagattttccgtttgacagttcagatgcgcaactcactgagtgagttagaagatcgcgattacgaccgtctgatctcaccggtccttaatgaaaacaacattttctacgactcagcaaaggcgggtgatgccctgccaaaggatgcggacgctaatggcgcctactgcatcgccctgaaaggattgtatgaaattaagcagattacagaaaattggaaggaagatggtaaatttagccgtgataaattaaaaatctcgaacaaggattggttcgattttattcagaacaaacgttatttg

SEQ ID NO: 29 - DNA, 3789 bp, Artificial Sequence
  Description of Artificial Sequence: Synthetic polynucleotide
atgaacaatggaacaaataattttcaaaattttatcggcatctcaagtcttcaaaaaacccttcgcaatgccctgattccaactgaaacaacccagcaatttatcgtcaagaacggcatcattaaggaagacgagttacgcggggagaaccgtcaaatcctgaaagatatcatggatgactactatcgtgggttcatttcggaaaccttgtcttcaatcgacgacattgactggacgagtcttttcgagaaaatggaaattcagcttaaaaatggagacaacaaggatactctgattaaggaacagacagaatatcgcaaagctatccacaaaaagttcgctaatgatgatcgtttcaaaaatatgttttctgctaaattgatttccgatatcttgcctgaatttgtaatccacaacaacaattattctgcttccgagaaggaagagaagacccaggtcattaaattattcagccgctttgcaaccagctttaaagactactttaagaatcgcgctaactgcttttcggcggatgacatctcatcatcatcatgccaccgcattgtgaacgacaatgcggagatcttcttttcgaatgcgttagtttatcgtcgcattgtcaaaagtcttagcaatgatgacatcaacaagatctcaggagacatgaaagattccttaaaggagatgtctcttgaggaaatctattcgtatgagaaatacggcgagttcattacccaggaaggtattagtttctacaatgatatctgcggcaaagtaaattcttttatgaatctgtattgccaaaaaaacaaagaaaacaagaatctttataagttacaaaagttacataagcaaattctgtgcatcgctgatacatcttatgaggtaccctacaaatttgaaagtgatgaggaggtctatcagagtgtcaacggcttcttagacaacatctcttccaaacatatcgtggaacgcctgcgtaaaatcggagataactacaacggatataacttagataaaatctacatcgtgtccaagttttatgaaagtgtgagccaaaaaacatatcgtgactgggaaaccattaacaccgcattggaaattcactataacaacattttgccaggcaacgggaaaagtaaggcggacaaagttaagaaagcagttaaaaatgacctgcaaaaaagcatcactgaaattaacgaattggtatcgaattacaaattatgtagcgacgataatatcaaagcagaaacttacattcacgagattagtcacattttaaataacttcgaggcccaggaattgaaatacaatcccgaaattcatttggttgaatcagaactgaaagcatcagagttgaaaaatgtgttagatgtcattatgaatgcgtttcattggtgctctgtgttcatgaccgaggaactggttgataaagataacaacttttacgctgaattggaggagatttacgatgagatttacccggtcatttcgctttataacttagtgcgcaattatgtgacgcagaaaccatattccacgaagaaaatcaaacttaattttggcatccctactctggctgatggttggtcgaaatcgaaagagtacagcaacaacgcgatcattcttatgcgtgacaatctttactatttgggcatttttaatgccaagaataagccagataagaaaatcattgaggggaatacttccgagaataagggggattacaaaaagatgatctataacttgctgcccggccccaacaaaatgattcctaaggttttcttgtcaagcaagacgggcgtcgaaacatataagccgtcagcttatattctggaaggctataaacagaataagcacatcaagtcttccaaggactttgacatcactttttgccacgatttgatcgactactttaagaactgtattgcgattcatccggaatggaagaacttcggtttcgacttttccgatacctcaacatacgaggatatcagcggcttctaccgtgaagtcgagcttcaaggctacaagatcgattggacatatatttcagagaaggacattgatttgttacaagagaaaggtcaactttacttatttcagatctataacaaagacttttcgaagaaatcgacaggaaacgataacttacacactatgtatttaaaaaatctgttttcggaggaaaacctgaaagatattgtgctgaaacttaacggcgaggcagagatctttttccgtaaaagctcaatcaagaatcctatcatccataaaaaaggtagtattcttgtcaaccgcacatatgaagcggaggagaaggaccaattcggaaacatccaaattgtccgtaagaatattccggagaacatttaccaagagttgtataaatactttaacgataagtcagataaggaacttagcgatgaggcggcgaagcttaaaaacgtagttgggcatcatgaagctgctaccaacattgtaaaagattaccgttacacctatgacaagtatttcttgcacatgcccattacgatcaatttcaaagcaaataagacaggctttatcaatgatcgcatcctgcagtacattgctaaagagaaggatttgcatgttatcggtattgatcgcggagagcgcaatttgatctacgtctccgtaatcgacacttgcggtaacattgttgagcagaagtcgttcaacatcgttaatggttatgattaccaaatcaagctgaagcagcaagagggtgcccgccagatcgcgcgtaaggaatggaaagaaatcgggaaaattaaagagatcaaagaaggctatttgtctctggtaattcacgaaatcagcaagatggtgatcaagtataacgcgatcattgcgatggaggatctttcttatggcttcaagaaagggcgctttaaagtcgaacgccaggtctaccagaaatttgagacaatgcttatcaacaagcttaactatcttgtatttaaggatatttccatcactgagaacggaggacttttaaaggggtaccaactgacgtacattcctgataagctgaagaacgttggtcatcaatgcggatgcatcttctatgtgccagcggcttacacctccaaaatcgatcccactacaggctttgtcaatatcttcaaattcaaggatttgaccgttgacgcgaagcgcgagtttatcaagaagtttgatagcattcgctacgacagcgaaaaaaatttattttgttttactttcgactacaataactttattactcagaacactgtcatgtcaaagagttcgtggagtgtctacacgtacggagtacgtattaagcgccgtttcgtcaacggacgcttctcaaacgaaagcgacacgatcgacatcaccaaagacatggaaaaaactcttgagatgacggatatcaattggcgcgacggccatgacctgcgtcaggatatcattgattacgagatcgttcagcacatcttcgaaatcttccgccttaccgtccagatgcgcaacagtttaagcgagcttgaagaccgcgactacgatcgtttgattagccccgttctgaacgagaataatattttctacgacagcgcaaaggccggtgatgctttgccaaaggacgcagacgcgaatggagcctactgcatcgccctgaagggcttatatgagattaagcaaattaccgaaaattggaaggaagatggtaagttctcccgtgataagcttaaaattagcaataaggattggttcgacttcatccagaacaaacgttacctg

SEQ ID NO: 30 - DNA, 3789 bp, Artificial Sequence
  Description of Artificial Sequence: Synthetic polynucleotide
atgaacaacggaacaaacaatttccaaaacttcatcggtatctcttcgttgcagaagactctgcgtaatgctttgatcccgacggagacaacccaacaatttatcgtcaaaaacggtattattaaggaggacgagttacgtggagaaaatcgtcaaatccttaaggacatcatggacgattattatcgcgggtttatttctgaaaccctgagcagtatcgatgatatcgactggacctcactttttgagaaaatggagatccagttgaagaacggtgataacaaagacactctgatcaaagagcaaactgaataccgcaaggcaattcacaaaaagttcgccaacgacgaccgtttcaagaatatgttctcagctaagttaatcagcgacattttgccagagttcgttatccacaacaataattatagtgcttcagagaaggaggaaaaaacccaagtgattaaacttttttcgcgctttgcaacctcattcaaggactacttcaagaatcgcgcgaattgcttcagtgcggacgacatttcttcttcaagttgccatcgtatcgttaacgataacgcggaaattttcttctctaatgctttggtgtatcgccgcattgtaaaatcgcttagtaacgatgacattaataagatctcaggtgatatgaaagattcattgaaggaaatgagcttggaagagatttacagttacgaaaaatatggagaatttattactcaggaaggcatctcattctataacgatatctgcgggaaggtaaattcgtttatgaacttatattgccagaaaaataaagagaataaaaatttgtataagcttcagaagttgcacaaacagatcctgtgcattgcagacacctcgtatgaggttccgtataaatttgagtccgatgaagaagtgtatcagtctgtgaatggtttcttagataatatctcttccaagcatattgtcgaacgcctgcgcaaaattggtgataactataacggatacaatctggataaaatttacatcgtttctaaattttacgagtcagtctcgcagaagacctaccgcgactgggaaacaattaacacggcattggagattcactacaataatatcttgcctggtaacggtaagtctaaggcagataaggtaaaaaaagctgtgaaaaacgaccttcagaaaagcatcacggagattaatgagctggtgagtaattacaaattatgttcagacgataatattaaagctgaaacgtatatccatgaaatctcgcatatcttgaacaacttcgaggcccaagaacttaaatataaccccgaaatccatttagtcgagtctgaattgaaagcgtcggaattaaaaaacgtcttagacgtcattatgaacgcgtttcactggtgttcagttttcatgaccgaagagctggtcgacaaagacaacaacttctatgcggaattggaggaaatctatgatgaaatctaccctgttatttcactgtataaccttgtgcgcaactatgtcactcagaagccgtattcgaccaaaaaaattaaattgaatttcggtatccctactcttgcagacggatggagtaaaagcaaggaatacagtaataacgccattattcttatgcgcgacaatttatactacctgggcatctttaacgcaaagaataagccggataagaagattattgagggtaacaccagtgagaacaagggcgactataagaagatgatctataacttattgccaggtccaaataaaatgatcccaaaagtattcttatcatcaaagacgggagttgaaacctataagcctagtgcctatattcttgagggatataaacagaacaagcacattaagtcgtctaaggattttgacattacgttctgccatgacttaatcgactattttaaaaactgtattgcgattcaccccgaatggaagaattttggattcgatttttcggatacctcgacctatgaagatatttcgggattttatcgtgaagtggagttgcaaggctataaaatcgattggacctatatctcagaaaaagacattgatttattacaggaaaagggacaactgtaccttttccaaatttataacaaggacttttctaaaaagtccacaggaaatgataaccttcacaccatgtacctgaagaaccttttctcagaggaaaacctgaaggacattgtccttaagttaaatggagaagcggagatctttttccgtaaatctagtatcaagaatccgattatccataaaaaaggttcgattttggtaaatcgcacctatgaagcggaagagaaagatcaatttggtaacatccagatcgtgcgcaagaatatcccggagaacatttaccaagagctgtataagtacttcaatgataagtctgataaggaactgtcagatgaagctgcgaaattgaagaacgtggttgggcatcatgaagccgctaccaatatcgtcaaggattaccgttatacctatgacaaatatttcttacacatgccgattacgatcaattttaaggcaaacaagacaggattcatcaacgaccgtatcttgcagtatattgccaaagagaaggatctgcatgtgatcggtattgaccgcggggagcgcaatttaatctatgtatcggtgatcgatacttgtggtaacatcgtagaacaaaagagctttaacatcgtgaatggttacgactatcagatcaagctgaaacaacaggaaggagcccgccagatcgctcgcaaggaatggaaagaaatcgggaaaattaaggaaatcaaggaaggctacctttcattggtcattcacgaaatttcgaaaatggtaattaagtacaacgcgatcatcgccatggaggacctttcgtacggatttaagaagggtcgtttcaaagttgagcgccaggtataccaaaaattcgagactatgcttatcaacaaacttaactacttggtctttaaggacatttctattaccgaaaacggcggcttacttaaaggctatcaattgacatatattcccgacaaactgaagaatgttggacatcaatgcgggtgtattttctatgtgccggcagcttacactagtaagatcgaccctacaaccgggttcgtaaacatttttaaattcaaagacttaacagtcgatgcgaagcgtgaatttattaagaagtttgatagtatccgctatgacagtgaaaagaacttgttttgctttacgttcgactacaataactttattacacagaacacggtcatgtctaaatcatcatggtcggtttacacatatggggtgcgcatcaagcgtcgctttgtaaatggccgttttagtaatgagagcgacacaatcgacatcacaaaggatatggagaaaactcttgagatgacagacatcaattggcgtgacggtcatgacttacgccaagatatcatcgactacgaaatcgtacagcatatttttgagatttttcgtcttactgtgcaaatgcgtaattctttatccgaactggaagatcgtgattacgaccgcttgattagtcccgtcttaaatgagaacaatattttctatgattctgcgaaagccggagatgcactgcccaaagacgctgatgccaatggcgcgtattgcattgcattaaaaggattatatgagattaaacagattaccgaaaattggaaagaggacggtaaattctcacgcgataaattgaagatttctaacaaggactggttcgactttatccaaaataaacgttatctt

SEQ ID NO: 31 - DNA, 3789 bp, Artificial Sequence
  Description of Artificial Sequence: Synthetic polynucleotide
atgaataacggtaccaacaactttcagaatttcattggcattagctcgcttcaaaaaactttacgcaatgctcttattccgactgagacgacacaacagtttatcgttaagaatggcatcatcaaagaagatgaattacgcggagaaaaccgccagatcctgaaagacattatggacgattattaccgtgggttcatctccgagacgttgtcatcgatcgatgacatcgactggacgtcactttttgaaaaaatggagatccagttaaagaacggtgacaataaggatacattgatcaaagaacagaccgagtaccgtaaagcgattcataaaaagtttgcgaacgatgatcgcttcaagaatatgttttctgcgaaattaatttccgacattttacctgaatttgttattcataataacaactactcggcgtctgagaaagaggagaaaacccaagtgattaaacttttttcacgtttcgcaacgtcgttcaaagactattttaaaaatcgtgctaattgctttagcgcggatgacatcagctctagttcatgtcatcgcattgtcaacgataatgctgagatctttttcagtaatgcgttagtgtaccgtcgtattgtgaagtccttatctaatgatgatatcaataagatcagcggggatatgaaggactcacttaaggagatgagcttggaggaaatctattcctatgagaagtatggtgagtttattacgcaagaaggaattagcttttacaacgatatctgtggaaaggtgaattcgtttatgaatttgtattgccagaaaaataaggagaacaagaacctttataaattgcaaaagttacacaagcaaatcctgtgcattgcagatacttcctacgaggtgccttacaagtttgaatccgacgaagaggtctaccaatctgtaaacggtttcttagataatattagttccaagcatattgtggagcgccttcgtaaaattggcgataattacaacggttacaatttagacaaaatttacattgtcagtaaattctacgagtccgtatctcaaaagacgtatcgtgattgggagactatcaatacggccctggagatccactacaacaatatcttgcccggtaatggtaagtcgaaggccgataaagttaagaaagcggtgaaaaatgacttacagaagtcaatcaccgaaattaacgaattggtgtccaattataaattgtgttcagatgataatatcaaagccgagacctacattcatgagatttcccatatcttaaataatttcgaggcgcaagagcttaagtataacccagaaatccacctggtagaatctgagttgaaggcgtcagagttaaaaaatgttttagatgtcattatgaacgcgtttcactggtgctccgtatttatgacggaggaattagtagataaagacaacaatttctatgccgaacttgaggaaatctatgatgagatctatcccgtcattagcctgtataacttggtccgcaactatgttacccaaaaaccgtacagtaccaagaagattaagctgaatttcggcattcctacactggctgatggttggagtaaatcgaaggaatattcgaataacgcgattatcttgatgcgcgacaacttatactatttggggatctttaacgccaaaaacaaaccggataagaagattattgagggaaacacatcagagaacaaaggcgactacaaaaaaatgatttacaacttgttaccggggcctaacaaaatgatcccgaaggtgttcttatccagtaaaacaggcgttgagacctacaaaccttccgcatacatcctggaagggtataagcagaacaagcacattaagtccagcaaggatttcgatattaccttctgtcatgatttaattgactatttcaagaactgtattgcaatccaccccgagtggaagaacttcggattcgacttctcagatacgagcacatatgaggacatctcggggttctatcgtgaagtagaactgcagggatataaaattgattggacatatatttccgaaaaagacatcgaccttttacaagagaagggtcaactttacttgttccaaatttacaataaagacttctcaaaaaaaagcacgggtaacgataatttacacactatgtatttaaagaaccttttctcggaagagaatttaaaggatatcgtattgaagttgaatggagaagcggagatcttcttccgtaagtccagtattaaaaaccctattattcacaagaagggatcgattttagttaaccgcacatacgaggccgaagagaaggaccaatttgggaacattcaaattgtccgcaaaaacatccctgagaacatttatcaagagctttataagtactttaacgataagtccgataaggaattgtcagatgaggcggcaaagttgaagaatgtcgtggggcatcatgaagctgccaccaacattgtgaaggactaccgctacacttacgacaaatacttcctgcacatgcccattacgatcaattttaaggccaataagacaggctttattaacgaccgtattcttcaatatatcgctaaggagaaggaccttcatgtgattgggatcgaccgcggagaacgtaatttaatttatgtgtccgtcatcgatacgtgtggaaatatcgtggaacagaaatcattcaatatcgtgaatggctatgattaccagatcaaattaaaacagcaggagggcgctcgccaaattgcgcgtaaggaatggaaagagatcggaaaaatcaaagaaatcaaagaaggatatttgtcattggtgatccatgagatttcaaaaatggtaattaaatataatgcaattatcgcaatggaagacctgtcctatggttttaagaagggtcgtttcaaggtagaacgccaagtgtatcaaaagttcgagacgatgctgatcaataagctgaattatcttgtgtttaaggacattagcatcacggaaaatggagggctgttgaaaggctatcaactgacgtatatccctgacaagctgaaaaatgttggccatcagtgcgggtgcattttctacgtccccgcggcgtatacaagcaagatcgatcctactacgggattcgtaaatatttttaaattcaaagacttaaccgtggacgccaagcgcgaattcattaagaagtttgatagcattcgctacgattcagaaaaaaatcttttctgttttacgttcgattacaacaattttatcacccagaacacagtgatgagcaagtcatcctggtctgtctatacctacggtgtccgtatcaaacgccgcttcgtcaacggacgcttctctaatgaatctgataccattgacatcaccaaggacatggaaaagacacttgagatgacagatattaactggcgtgacggacatgacctgcgtcaggacatcatcgattatgagattgttcagcatatcttcgagatcttccgcctgacagtacaaatgcgcaattcactgtcagaacttgaagaccgcgactatgaccgcctgatctctccagtattaaatgagaacaatatcttttatgacagtgctaaggccggcgatgcccttccgaaagatgctgatgctaacggagcttattgtattgcattaaagggtctttatgagatcaagcaaattaccgagaattggaaggaggatggcaaattctcgcgcgacaaactgaaaatcagtaacaaggactggttcgattttattcagaataaacgttacctg

SEQ ID NO: 32 - DNA, 3789 bp, Artificial Sequence
  Description of Artificial Sequence: Synthetic polynucleotide
atgaataacggaacgaacaacttccagaacttcatcggcatcagttctttacaaaaaaccctgcgtaacgcccttattccgactgagacaacacaacagttcatcgttaaaaacggaattatcaaagaggacgagttgcgcggcgagaatcgccaaattttgaaagatattatggacgactattatcgtggttttatttcagaaacactgagttcgattgacgatatcgattggacgagcctgtttgagaaaatggaaatccagttgaaaaatggcgataataaagacactttaatcaaagaacaaaccgagtatcgtaaagcgatccataaaaagttcgctaatgacgatcgttttaagaatatgttcagtgcgaaactgatttcagacattttgcccgagttcgtgatccataataacaactattccgcctcggaaaaggaagaaaaaacccaggtgattaagctgttcagtcgcttcgcaacatctttcaaggattatttcaagaatcgcgcgaattgcttcagtgcggacgatatttctagttcaagctgccatcgtatcgttaatgataacgcggagattttttttagcaatgctctggtgtaccgccgcattgttaagtcactgtccaacgatgatattaacaagatctcaggagacatgaaagactcgcttaaagagatgagtctggaagagatctattcttatgagaagtatggcgagtttattacccaagaaggaatctcattctacaatgatatttgtggaaaggtgaacagctttatgaatctttactgccaaaaaaacaaggagaataagaatctttacaaacttcagaagttacataaacagattttgtgtattgcggatacgtcttatgaagtcccctacaaatttgaatcggatgaagaggtataccaaagtgtgaacggattcttggacaatatttcttctaaacatattgttgaacgcttacgtaagatcggggataactacaatggctacaatcttgacaaaatctacattgttagcaaattctacgagagtgtcagccaaaagacgtaccgcgattgggaaacaattaatactgcgcttgagattcactataataacattttaccaggcaacggcaagtccaaggcggataaagttaaaaaagctgttaaaaacgatttgcaaaaatctatcacagaaattaacgagttagttagtaactacaaactgtgctccgatgacaacattaaggctgagacgtatatccatgagatctctcacatcttaaacaattttgaagctcaagaacttaagtacaatccggaaatccacctggtggaatccgagctgaaggctagcgaactgaagaacgtattggacgtgatcatgaacgcgttccactggtgttctgtctttatgacggaagagcttgtcgacaaagataataacttttacgcggaacttgaggaaatttacgatgagatttacccagttatttcattgtataaccttgtccgtaattacgtgacccaaaagccttatagtacgaaaaaaatcaaattaaattttggaatcccaacactggctgacggttggagcaaatctaaggagtattctaataacgcaatcatcttaatgcgtgacaacctgtattatttgggtatcttcaatgccaaaaataagcctgacaaaaagattatcgaaggaaatacttcggagaataagggggattacaaaaaaatgatttacaatttgctgcccgggccgaacaagatgatccccaaagtgttcttatcctcgaagactggtgtagaaacatacaagccaagcgcatacattctggagggttacaagcaaaacaaacacatcaaatcttcaaaagactttgacattacattttgccatgatcttattgactacttcaaaaactgcattgctattcaccccgagtggaagaactttgggtttgacttcagcgacacgtctacgtatgaggacatctccgggttctaccgtgaagttgagttacaagggtataagattgactggacgtatatttcagagaaagatatcgatcttttgcaggaaaagggccagttatatttattccagatttacaacaaggactttagtaagaagtcaacaggaaatgacaacttgcatacgatgtatttgaaaaatcttttttctgaggaaaatcttaaggacatcgtactgaaattgaatggcgaggctgaaatcttcttccgtaaatcctccattaagaatcccattatccacaaaaaggggtctatcctggtgaatcgtacctacgaggcagaggagaaggatcaattcggaaatattcagattgttcgtaagaacatccccgagaacatttatcaagaattgtataagtactttaatgacaaatctgacaaagagttatccgacgaagctgcgaaactgaaaaacgttgttggtcaccacgaggccgccactaatatcgtaaaagactaccgttatacctatgacaagtactttttgcacatgccgatcactatcaacttcaaggcgaataagacgggcttcattaacgatcgtatcctgcaatacatcgccaaggagaaggaccttcacgtcattgggattgaccgtggtgagcgtaacctgatttatgtaagcgtcattgatacctgcggtaatatcgtcgaacagaaaagtttcaacattgtaaatggatatgactatcagatcaaacttaagcagcaggagggtgcacgccagattgcccgcaaggaatggaaggagattgggaagattaaggaaattaaagaaggttacttatcactggttattcacgagatcagtaaaatggtaatcaaatataacgcgatcattgccatggaggatctgagctatggctttaaaaagggccgtttcaaagtcgagcgccaggtatatcaaaagtttgaaacaatgctgattaacaaattaaactatctggttttcaaagatatttcgatcactgaaaatggcgggctgttgaagggataccaacttacatacatccctgacaaactgaaaaatgtcggtcaccaatgtggatgtatcttttatgtaccagcagcgtatacgagcaaaatcgatccaactacgggttttgtgaacatctttaagttcaaggatttgacagtagatgccaaacgcgagttcattaaaaaatttgattcaattcgctacgattcagagaaaaatcttttttgtttcacgttcgattacaataatttcattacgcagaacacagtaatgtcaaagtcaagctggtcggtctacacgtatggagtccgtattaaacgtcgttttgtaaacggccgtttctcaaatgaatcagatacaattgatattacgaaggatatggagaagacattagagatgactgacattaactggcgcgacggacatgatcttcgtcaggacattattgattatgagattgtacagcatatctttgagatcttccgcctgaccgttcagatgcgcaattcgttgtccgagttagaagaccgcgattacgaccgtttaatcagtcccgtcttaaacgaaaataacatcttctacgattcagccaaggcaggcgatgccttgccaaaggatgctgacgcaaatggcgcatactgtattgcgttgaaaggcctttatgaaatcaagcaaattaccgaaaactggaaagaagacggaaaattctcccgtgataagttgaaaatctctaataaggattggttcgatttcatccaaaataaacgctatttg

SEQ ID NO: 33 - DNA, 3788 bp, Artificial Sequence
  Description of Artificial Sequence: Synthetic polynucleotide
atgaacaacggaactaataatttccaaaattttataggcatctcttctttacagaagactcttcgtaacgccctaatcccgactgagaccacacaacaattcatagtgaaaaatgggatcattaaagaagacgagctgcgtggggagaacaggcagatcctaaaagacataatggacgattattatagagggttcatctcagagacattatctagcatcgacgacattgactggacctccctgtttgaaaaaatggaaatccagctgaagaatggtgacaataaagacacattaataaaagaacaaacagagtacaggaaagccatccacaagaagttcgcaaacgatgacagattcaaaaatatgttcagtgcgaagctaatatccgacatcttaccagagtttgtaatacacaataacaattacagcgcgagcgaaaaggaagagaaaacgcaagtaattaagctttttagtaggttcgctacctctttcaaagattacttcaaaaatcgtgctaactgcttctcagccgacgacatatcttcaagttcctgtcaccgtatcgtgaatgataacgctgagatattcttctcaaacgcccttgtataccgtaggatcgtaaagtccttatctaacgatgatataaacaagatcagtggagacatgaaagacagccttaaagagatgtctctagaagaaatttactcctatgaaaagtatggggagtttataacacaggaggggatcagcttctacaacgacatctgcggaaaggtgaacagtttcatgaatctttactgccagaagaataaagagaacaaaaatctttataagcttcaaaagttgcacaaacaaatactgtgcattgccgatacatcatatgaggtcccctataagttcgaatctgatgaggaagtttatcaatctgttaacggctttctagacaatatcagctcaaaacacatcgtagaaagactgaggaaaataggtgataattataatggatacaacttggataaaatatatatagtctctaaattttacgagtcagtatcccagaaaacgtatagggattgggagaccatcaacacggcgttagagattcattacaataacatcttaccgggaaacggaaaaagtaaggcggacaaagtaaagaaagccgttaaaaatgacttacaaaagagtataacagaaataaacgaactagtaagcaactacaagctttgttccgatgataatatcaaggccgagacatatatccatgagatctcccacattctaaacaatttcgaagcgcaagaacttaaatataatcccgaaatccacctggtggaaagtgaactaaaggctagtgagttaaagaacgttcttgatgttatcatgaacgccttccattggtgctctgtttttatgaccgaggagttggttgataaagataataatttctacgctgaattagaggagatatacgacgaaatctacccagtgatttcactatacaacttggtcaggaactatgttacacaaaagccgtacagcactaagaaaattaagctaaatttcggtatccccacgttagccgacgggtggagcaagtccaaagaatattccaacaatgcgattattttaatgcgtgacaatctttattaccttggcatcttcaatgccaaaaacaaacctgacaaaaagattatagaaggtaatacgtccgagaacaaaggcgattacaagaagatgatttataacctactgcccggaccaaacaaaatgatccccaaagtttttcttagttctaaaaccggcgtagagacgtataaaccttctgcctatatcttagagggatataagcagaacaaacatatcaaatcttccaaggactttgatattacattctgccacgatttaattgactacttcaaaaattgcatagcgatacatccggagtggaagaactttggcttcgacttcagtgatacatccacctatgaggatatatcaggcttctatcgtgaggtcgaattgcaagggtacaaaatcgattggacgtatatatccgagaaagacatagaccttcttcaagaaaaggggcagttatatttattccaaatatacaacaaggacttcagtaagaagtcaacaggtaatgacaacttacacaccatgtacttgaaaaatttattttctgaagaaaacctaaaggacattgtactaaaactgaacggggaggcagaaattttttttagaaagagcagcataaaaaacccaataattcataagaaaggaagcattttagttaataggacgtacgaggcagaggaaaaggaccagtttggcaatatccagatcgtaaggaaaaatattcctgaaaacatatatcaggaactatataaatactttaacgacaaatccgacaaagaattatccgacgaggctgcaaagctgaagaacgtcgtagggcaccatgaggcagcgactaatattgtgaaagactataggtatacatacgacaaatactttctgcacatgcccatcacgattaacttcaaggcgaacaagacgggattcattaacgaccgtatattacaatatattgctaaggagaaagatctgcatgtaataggtatcgacagaggcgaacgtaatttaatctacgtgtccgtcatcgacacgtgcgggaacatcgtagagcaaaagagttttaatatagtaaatggctatgattaccaaattaagctaaagcagcaagaaggagcaagacagatagctaggaaagaatggaaggagataggaaaaataaaggagatcaaggaggggtatcttagcctagtaattcatgaaatatctaagatggttatcaaatacaacgctatcatagcgatggaagacttatcttatggtttcaagaaaggaaggttcaaagtagagcgtcaagtttatcaaaagttcgaaacgatgttgattaataaactaaactatttggtatttaaagatatatctatcaccgagaatggtggtctactaaagggttaccagcttacatacataccggacaaacttaaaaacgtcggacatcagtgtggatgcattttctacgttccagctgcatataccagcaagatcgacccaacgactgggttcgtaaatatttttaaattcaaggatttgactgtcgacgccaaaagagagttcataaaaaagttcgattcaattaggtacgacagcgaaaagaatttgttctgctttacttttgactataacaatttcattactcagaacactgtaatgtctaagtcctcttggtcagtctatacttatggcgttcgtatcaaacgtagatttgttaacggtagattctcaaatgaaagtgatacaatagatatcacgaaagatatggagaaaacattagaaatgacagacataaactggagagacggacatgacttgagacaggacattattgactacgagatcgtgcagcacatctttgagatctttcgtttgaccgtacaaatgcgtaacagtttatctgagcttgaggacagggactacgatagattgatatcacctgtattaaatgagaataacatcttctatgattccgcaaaagcaggcgacgctctacccaaagacgctgatgcgaacggtgcttattgcatagctttaaagggtttgtatgagatcaaacagataacagaaaattggaaggaagatggtaagttctcccgtgacaagcttaaaatatcaaataaggactggttcgattttatacagaataagcgttatta

SEQ ID NO: 34 - DNA, 3789 bp, Artificial Sequence
  Description of Artificial Sequence: Synthetic polynucleotide
atgaacaatggaactaataacttccagaatttcattggtatctcctctttacaaaaaactctaagaaacgccctaattccgactgaaactacacagcaattcatcgtcaaaaacgggatcattaaggaggatgagttgaggggtgaaaatcgtcaaattcttaaagacatcatggacgactactacagggggttcatcagcgagacgttatctagtatagacgatatagactggacttcactgttcgagaagatggaaatccaattaaaaaatggggacaataaagatacacttataaaggaacagacagagtatagaaaggcaatacacaaaaagtttgccaacgacgatcgtttcaagaacatgtttagtgctaaattgatttcagatattctgccggaatttgttattcacaacaataattatagcgccagtgagaaagaagaaaaaacgcaggttatcaaactgttcagtcgtttcgctacatcttttaaggattactttaaaaaccgtgcaaattgtttttcagccgacgatattagtagcagctcttgtcaccgtattgttaatgataatgcggagattttcttttcaaacgcattggtctacaggaggatagtcaagtccctttcaaatgacgacattaataagatctcaggtgacatgaaagattccttaaaggaaatgtccctggaagagatctattcctatgaaaagtacggtgagttcattactcaagagggtataagcttttacaatgacatatgtggtaaggttaatagctttatgaacctgtattgccagaagaacaaagaaaataagaatctgtataagttgcaaaagctacacaaacaaattttgtgcattgccgatacatcatacgaggtgccatacaaattcgagagcgatgaggaggtttatcagagcgtgaatggattcctggacaatattagtagtaagcatatcgtggaaaggcttagaaagataggtgacaattacaatggctacaatctggataaaatctacatcgtctcaaaattctatgaaagtgtatcccagaagacgtaccgtgattgggaaactatcaacaccgctctggagatacattacaacaatatacttcccggaaacggcaagtcaaaagccgacaaagtcaaaaaagcggtcaagaacgatttacaaaagtctatcactgaaattaatgaattagttagtaattacaaactgtgtagtgatgataatattaaggcagagacttacatacacgaaatttcacacattttaaacaacttcgaggcacaggaacttaaatataatcctgaaattcacctggttgaaagtgaattgaaagccagcgagctaaagaacgttttggacgtaatcatgaacgcattccactggtgctctgtctttatgacagaggaactagtggataaggacaataatttttatgcggagctggaggaaatatacgatgagatatatcccgtaatatcattatataatctggtaagaaactatgtgactcaaaagccgtatagcaccaagaaaattaaacttaatttcggcatacccactttagcggacggctggtcaaaatccaaagagtatagtaataatgccatcatcctgatgcgtgacaacctgtactatttaggtatatttaacgccaaaaataaacccgacaaaaagattatagagggcaacacctcagagaacaaaggtgattataagaagatgatttacaaccttttacccggtcctaataagatgattcccaaagtctttctatctagcaaaactggtgttgaaacatacaaaccctcagcttatattttagaagggtataagcagaataagcatattaaaagctccaaagatttcgatattaccttttgccatgacttgatagactatttcaaaaattgtattgccattcaccctgaatggaaaaacttcggatttgacttctctgacacatccacctacgaagacatttcaggtttttacagggaagtcgagctacagggttataaaattgattggacatacatcagcgagaaagatattgacctacttcaagaaaaagggcagctatacctgttccagatatacaataaagacttcagtaaaaaaagcaccgggaacgataatcttcacacaatgtacttaaaaaatttatttagtgaagagaatctgaaggatatagtgctgaagttaaacggggaggcagagatattttttagaaaatctagtattaagaatccgatcatccacaagaagggttctatccttgttaataggacttatgaggcagaagaaaaagaccaattcggcaacatacaaattgtccgtaaaaatatccctgagaacatttatcaggaactatacaagtacttcaatgataaaagcgacaaggagctgagcgacgaggctgctaagttaaagaatgtggtgggccaccatgaggcagcaacgaatattgtgaaggactatcgttatacctacgataaatactttcttcatatgccgatcaccattaatttcaaggcaaacaaaactggcttcattaacgatcgtatcttacaatatatcgcaaaagagaaagaccttcacgttatcgggatcgatagaggcgagcgtaacctaatttatgtttctgtgatagacacctgtgggaacatagtcgaacagaaatcatttaatattgttaacggctacgattatcagataaagttgaagcaacaagagggtgcacgtcaaatagcaaggaaagaatggaaagaaataggcaagattaaagaaataaaagaaggttatttatcccttgtaatacacgaaattagcaaaatggtgattaaatataatgcgatcattgccatggaggatctttcttacggcttcaaaaaggggagattcaaagtcgagaggcaggtgtatcagaagtttgagaccatgctaatcaataaactaaattatctagtattcaaagacataagcatcaccgaaaatggcggcttgttgaagggttatcaattgacctacatcccagataaactaaaaaacgtagggcatcaatgcggatgtatattttacgttccagccgcatacacttccaaaatcgatccaactacgggttttgtgaacatcttcaaattcaaagacttgactgtcgatgctaagagggagtttatcaagaaatttgactccattagatacgacagtgagaagaatctgttctgttttacctttgattataacaactttataactcaaaacacagtcatgagtaagtcatcttggtcagtgtatacgtatggtgtgaggattaaaaggaggtttgttaacgggagattttccaatgaaagtgatacaatagatataaccaaggacatggaaaagactcttgaaatgaccgacattaactggagagatggccacgacttacgtcaagatataatcgattacgagatagtgcaacatatctttgagatatttaggcttactgtccaaatgcgtaactcattaagtgagttggaggacagggattacgataggctaataagtcctgttcttaacgaaaacaatatattctacgattcagcaaaggcgggagacgccctgcccaaggacgcggatgctaacggcgcatactgtattgccctgaaaggcttgtacgagataaaacagatcacggagaactggaaagaagatggaaaattcagtcgtgacaagttaaaaattagtaacaaagactggttcgactttattcagaacaagagatatctg

SEQ ID NO: 35 - DNA, 3789 bp, Artificial Sequence
  Description of Artificial Sequence: Synthetic polynucleotide
atgaacaacggaaccaataactttcaaaactttataggcatctccagtctacagaagacactacgtaacgctttgataccaactgagaccacgcagcagtttatcgtcaagaacggtattataaaggaagacgagctaaggggggaaaaccgtcagatcttaaaggacatcatggatgactactacagaggcttcataagtgagactttgtctagtatagacgacatcgactggaccagtttatttgagaagatggaaattcagttaaagaacggggacaataaagacacactaattaaagagcagaccgaatacagaaaagctatacacaaaaagtttgccaacgatgatagattcaaaaatatgttttcagcaaaattgatttccgacatattgccagaattcgtaatccataataacaattattctgcaagtgagaaggaagagaagacccaagtaatcaagctgttttcccgttttgctacgagtttcaaagattatttcaagaatagggctaattgtttctccgcggacgacataagtagcagttcctgtcacaggattgtgaacgataatgctgagatatttttttccaatgccctagtgtataggagaatagttaaaagcttaagcaacgacgatatcaataaaatttcaggggacatgaaggacagcttaaaggaaatgagtttggaggagatttacagttatgaaaaatacggagagtttataactcaggaaggcatctctttctataatgatatctgtgggaaggtaaactccttcatgaatttatattgccagaagaataaggaaaacaaaaatctttacaagcttcaaaagttacataagcagatcttatgtattgccgacacgagttatgaagtgccttataaattcgagagtgatgaggaagtgtatcagtctgttaacggattcctagataatataagttccaaacatatagtcgagaggctgaggaagattggcgataactataatggatataatcttgacaaaatctatatagtctctaaattttatgaaagcgtcagccagaagacatatagagattgggaaactataaacacagcccttgaaatacattacaataacatcctacccggcaatggtaagtctaaggcagacaaagttaaaaaagcagtaaagaatgacttacagaagtcaatcacggagataaatgagttggtcagtaactacaaattatgctccgacgataatattaaggccgaaacatatatacacgagataagtcatatattaaacaatttcgaagcccaggagttaaaatataaccctgaaattcatctggtcgaaagtgagttaaaggccagtgagttaaagaatgtacttgacgtaattatgaatgcttttcattggtgctccgtgttcatgaccgaggagttagtagataaagacaataacttttacgccgaacttgaagagatatacgacgagatttatccggtaatcagcttgtacaacttagttagaaattatgtaacacagaagccttactctactaaaaaaataaaactgaactttggtatcccaactcttgcagatggttggagtaaaagcaaggaatatagcaacaatgcgatcatcttgatgagagacaacttgtactatttgggaatcttcaacgcgaaaaataaacccgacaaaaaaatcatcgaagggaatacctctgagaataaaggtgactataagaaaatgatttacaatctacttcctggtcctaataaaatgatcccgaaagtgtttcttagttctaagactggtgtcgagacgtacaaacctagcgcgtacatcttagaagggtacaagcagaataaacacatcaaatcaagcaaagacttcgatattactttttgccatgacttgatagactactttaaaaactgcatagcaatccacccggagtggaaaaactttggctttgatttctctgacacctctacatatgaggacatatctggtttttaccgtgaggttgaattgcagggatacaaaattgactggacttacatatctgaaaaagatatcgatctattgcaggagaaaggccagctttaccttttccagatctataataaggacttctctaagaagtctacagggaatgataatttgcacactatgtacttaaaaaatctgttttccgaggaaaacttgaaagacattgttttaaagttgaacggagaagctgaaatatttttcagaaagagctccataaaaaacccgatcattcataagaagggatctatcctggttaacagaacgtacgaagcggaagaaaaagaccaattcggaaacattcaaattgttagaaagaatatccctgagaacatctaccaggagttatataagtattttaatgataagtcagataaggaactatctgacgaagcggcgaagcttaaaaatgttgtaggacaccatgaggctgctacaaatatagtcaaggactaccgttatacctacgataagtactttctacacatgcccattaccatcaattttaaagctaataaaacgggttttatcaacgatcgtatcctacaatatattgcgaaagagaaggatttgcatgtcattggcattgatagaggtgagaggaacctaatatacgtatccgtgattgatacgtgcgggaacatagttgaacagaaatcatttaatatagttaatgggtacgactatcagattaagctaaagcaacaagaaggcgccaggcaaattgcccgtaaagaatggaaagagatcgggaagatcaaggaaataaaagaaggatacctttccctggtcatccatgaaattagcaaaatggtgattaagtacaatgccataatcgcgatggaggacttaagctacgggttcaaaaaggggaggtttaaggtggagaggcaagtgtaccagaaatttgagaccatgctaatcaacaaactgaactacctagtttttaaggacatttcaattacagagaatggaggacttttaaagggttaccaactaacgtatataccagataagttgaaaaatgtcggtcaccagtgtggctgcatcttttacgttcccgccgcttatacatctaaaattgatccaaccacaggctttgtaaatatctttaaattcaaagatttaactgtggatgcaaaaagagagtttatcaagaaattcgatagcattcgttatgatagcgagaagaacctgttctgctttactttcgactataacaactttataactcaaaacaccgtgatgtcaaaaagctcatggtcagtctacacctatggtgtaaggattaaaaggcgtttcgtgaatgggagattctccaatgaaagtgacacgatcgacataacaaaggacatggagaagacactagagatgactgatattaattggagagacggacacgatctgcgtcaagatataattgattatgagatagtacagcacatatttgagatcttccgtttgactgtccaaatgcgtaattccctttctgagctggaagatagggactatgatagattaatatcccctgtactaaatgagaacaacattttctatgatagtgcaaaagccggggatgcattgccgaaagacgctgacgctaatggggcgtactgtatagctttaaaggggctttacgaaataaagcagataaccgaaaactggaaggaagatggcaaattctcaagggacaaacttaagatctctaacaaggattggttcgattttatacaaaacaaacgttatttg

SEQ ID NO: 36 - DNA, 3789 bp, Artificial Sequence
  Description of Artificial Sequence: Synthetic polynucleotide
atgaataatggtacaaacaactttcagaatttcattgggatctctagcttacagaagaccctgaggaatgcgttgattccaactgaaacaacccagcaattcatcgtgaaaaatgggataatcaaagaggatgagttaaggggtgaaaaccgtcaaatattgaaggatattatggacgactactaccgtggattcatctcagagacgttgagcagcattgacgacatagactggactagccttttcgagaagatggaaattcagttaaagaacggagataacaaagatacactaatcaaggaacagacagaatacagaaaagcaattcataagaaattcgctaatgacgatcgttttaaaaacatgttctctgcaaaattaattagcgacattctgccggaattcgttatacataataataactacagtgcttctgaaaaggaagagaaaactcaggtaataaaactgttctctcgttttgccacatccttcaaagactactttaaaaatagagcgaactgctttagcgccgacgatattagttcttcctcatgccacaggattgtcaacgataatgcagagatattcttttctaacgcactagtctacagaaggattgtaaagtctttgtcaaatgatgacataaacaagattagtggagatatgaaagactctctaaaggaaatgagccttgaggagatatactcttatgaaaagtacggtgagtttattacccaagaaggcattagtttctataatgacatttgtggaaaagttaacagttttatgaatctatactgtcaaaaaaataaggagaataaaaatctttataagttgcaaaaactgcataagcagatattatgtatagcagacacgagctatgaggtaccgtacaagttcgagagcgatgaggaagtctaccaatctgtcaacggatttttggacaacatttcttcaaaacatattgtggagaggcttaggaaaataggcgacaattataatggatataacttagataagatatatattgtttccaaattctacgaatctgtaagccagaagacatacagagattgggaaacgataaacacagcccttgaaattcactataacaacatactacctggaaacggcaaatcaaaggccgacaaagttaagaaggccgtaaagaatgatttacagaagagcataacggagatcaatgagctggtgtctaactataaattgtgtagcgatgacaacataaaagccgagacttacattcacgaaatttcacacatacttaacaactttgaagctcaggaattaaagtataatcccgaaatacaccttgtggagtccgaactaaaggctagtgagcttaagaacgtcctagacgtaattatgaatgccttccactggtgtagtgtttttatgaccgaggaacttgttgacaaagataataatttttatgcagaactagaagagatatacgatgaaatatacccggtgatcagtttgtacaatcttgtcaggaactatgtgacacaaaagccctattcaacaaagaaaataaaacttaatttcggaattcctacgttagctgatggctggtctaaatccaaggaatacagcaacaacgctataattctgatgagagataacttgtactatctaggcatcttcaatgccaaaaataagcctgataagaagattatagagggcaacacttcagagaacaagggcgactacaagaaaatgatctataacctattgcctggcccaaacaagatgattccgaaggtcttcctatcatccaagaccggcgttgagacatacaagccatcagcgtatattttagaggggtacaaacaaaacaagcacataaagtctagtaaagacttcgatataacattttgtcatgacttaattgactactttaagaattgcatcgctatacacccggaatggaagaatttcggcttcgacttctctgatacatctacctacgaggacattagcgggttttaccgtgaagtcgaattacaagggtataagatagattggacgtacatctctgagaaagacatagacttgcttcaggaaaagggccagttgtatctattccaaatatacaataaggatttttccaagaaatctacgggtaatgacaatcttcacacaatgtatcttaagaaccttttctcagaagagaacctgaaggacattgtcttaaaactaaatggcgaagctgagatttttttcaggaagtcttcaattaagaacccgataatccacaagaaggggagtattcttgtgaatagaacttacgaggccgaagaaaaagaccaatttggtaacatccagatagtcagaaagaacattccagagaacatctaccaagagctatacaaatatttcaacgacaagtccgataaggaactgtccgatgaggcagccaagttgaagaatgtcgtgggtcatcatgaagctgctactaacattgtcaaggactatcgttatacttacgacaagtatttcctacacatgccgataacaattaatttcaaggctaacaaaacaggctttatcaacgatcgtatcttgcagtacatagctaaggaaaaggatttgcatgtgattggcattgatagaggggagcgtaacttgatatatgtgtctgtcatagacacgtgtggcaacatcgtcgaacagaaatcattcaacatagtaaacggctacgattaccaaattaagctgaaacagcaagagggtgcacgtcaaattgcgcgtaaagagtggaaagaaattggtaaaatcaaggaaattaaagaaggctacttgtctcttgttatacatgaaatttccaagatggttataaagtataacgcgataattgctatggaagacttatcatacgggtttaaaaaggggaggttcaaggtagagaggcaggtctatcaaaagttcgagacgatgttgattaataaactaaactatctagtgttcaaagatatcagcattacggagaacggggggctactgaaaggatatcaactaacgtacattcccgataagttaaagaacgttggtcatcaatgtggttgcatcttctacgtgcctgctgcctatacgtccaaaatagatccaactactggatttgttaacatctttaaattcaaagatttaaccgtagacgccaaaagggaatttataaaaaaatttgacagcatccgttacgatagcgaaaagaatctgttctgttttactttcgactacaataatttcatcacgcaaaatacggtaatgtctaagtcaagttggagcgtctacacgtatggagtcaggatcaagaggcgtttcgtaaatggaagattctctaatgagtcagatactatagacatcacgaaagatatggagaaaaccttggagatgacggatattaactggcgtgatggacacgatttaagacaggacattattgactatgagattgtgcaacacatcttcgaaatattccgtctaacagtccaaatgaggaatagcctaagtgaattggaggaccgtgattacgataggcttataagtcctgtccttaacgaaaacaatattttctatgatagtgctaaggcgggggacgcactgcctaaagacgcagatgctaacggggcatactgcattgcgttaaagggtctgtacgaaatcaagcagattacggaaaactggaaagaggatggcaagtttagcagagataagttgaagataagtaacaaagattggtttgactttattcagaataaaaggtattta

SEQ ID NO: 37 - DNA, 3789 bp, Artificial Sequence
  Description of Artificial Sequence: Synthetic polynucleotide
atgaataacggcactaataatttccagaatttcatcggcattagcagcttacaaaagacgttgaggaatgccttaatacccacagaaactactcaacaatttatagtgaagaatgggataattaaggaagacgagttgagaggtgaaaataggcaaatcttgaaagacattatggatgactactacaggggcttcattagtgaaacgttgtcttcaatagatgacattgattggacttctttgtttgagaagatggaaatacagttaaagaacggcgacaataaggatacacttatcaaagagcaaacagaatatagaaaagcaattcacaaaaagtttgctaacgatgataggttcaagaacatgtttagcgctaaactaatatcagacatccttcccgagttcgttattcataacaataactatagtgcaagtgaaaaagaggagaagacacaggtgattaagctgttctccagattcgcgacttctttcaaagattacttcaaaaacagagccaactgtttttcagctgacgatatctctagtagtagttgtcaccgtatagtgaacgataacgctgagatcttctttagcaatgcattagtgtatagaaggatagttaagtctctaagcaatgatgatatcaataaaatttccggagacatgaaggactccctaaaggaaatgtccttagaagagatctactcatatgagaaatacggggaatttattacgcaggaagggatctccttttacaatgacatatgcgggaaggtcaactctttcatgaacttatactgccaaaagaacaaggagaacaagaatttatataaacttcagaaacttcacaaacaaatactgtgcatagccgatacctcatatgaggttccttacaaatttgaatcagatgaagaggtataccaatccgttaacggctttcttgacaatattagctcaaagcacatcgtggagaggttgagaaagattggtgataattataatggctacaatctagataagatatatattgttagcaagttctacgagtctgtgtcccaaaaaacatatagggattgggagacaattaatactgctctagaaatccattacaacaacatccttcctggaaatggcaagagtaaggccgacaaagtcaagaaagcagtgaaaaatgatctgcaaaaatcaattactgagataaacgagctagtatctaattacaagctttgtagcgacgataacattaaggcagaaacgtacatacacgagattagtcacatcttaaataattttgaagcccaagaactgaaatataaccctgagatacaccttgttgaatccgagttaaaggcgtctgaactaaaaaacgtgttagacgttattatgaatgccttccactggtgtagcgtctttatgactgaggagttggttgataaggataataacttttacgctgaattggaagaaatttatgacgaaatctatcctgttatttctctatataatttggtgagaaattacgtaacgcaaaagccctatagtacgaaaaaaataaaactaaatttcgggatccctaccctagccgacggttggtctaaatccaaggagtactcaaacaatgcaataatattgatgagggacaacctgtactacctaggcatatttaatgccaaaaataagcccgataaaaagattatagaagggaacacgtcagaaaataaaggagactataagaaaatgatctacaaccttttgcccggccccaataaaatgatcccgaaggtcttcctaagtagcaagactggcgtagagacctacaaaccatctgcatacattttggaggggtacaagcaaaacaagcacataaagagtagtaaggattttgacattacattctgccatgacttaattgactactttaaaaattgcatcgcaattcaccctgaatggaaaaattttggatttgatttctctgatacttcaacatatgaggatatttcagggttctacagggaggtcgaactacagggttacaaaatagactggacgtatatttctgagaaagatatagatttgcttcaggaaaagggtcagctatatctgttccagatatataataaggacttctccaaaaagagtaccggaaatgataatctgcacacaatgtacttaaaaaacttgttctctgaggagaatctaaaagacatcgtactaaaacttaacggggaggccgaaattttttttaggaagtccagcatcaagaacccgattattcataaaaaaggtagcattttggtgaaccgtacttatgaggcggaagaaaaagaccaattcggtaatattcaaatcgttagaaagaacatccctgagaacatttatcaggaactatacaaatactttaacgacaaatcagataaggagctttctgatgaggcagctaaattgaaaaatgtagtgggacatcacgaagcagccactaacatagtgaaggactacagatacacatacgataagtacttcctgcacatgcctattacaattaactttaaagcaaataaaacagggtttattaacgacagaatcttacagtatattgccaaagaaaaggatctgcatgtgataggaatagacagaggagaaagaaacctgatatacgtctccgtgattgatacatgtgggaacatagtagaacagaagtcctttaacattgttaatgggtacgattatcaaattaaattaaaacaacaagaaggagcacgtcaaatagctaggaaagaatggaaagagataggaaaaattaaggaaattaaggagggttacctgtcccttgtaattcatgaaatatccaaaatggtaattaaatataacgcgatcatcgcgatggaagatctaagctacgggttcaaaaaaggcaggtttaaggtggagaggcaagtttaccaaaagttcgagacaatgttgattaataagttaaactacttagttttcaaagatatctccataaccgagaatggcgggcttttaaaagggtaccaactaacatatatcccggataaattgaagaacgttggacaccagtgtggctgcatattttatgtacccgctgcgtatacttctaaaattgacccgaccaccgggtttgtaaacatattcaagtttaaggacctaacagttgacgccaaacgtgagttcatcaagaagttcgatagtataaggtatgactctgagaagaaccttttctgcttcacgtttgactataataatttcatcacccaaaatacagttatgtcaaaaagctcttggtcagtatatacgtatggcgtaaggattaagcgtaggttcgtgaacggtagattttccaacgagtcagatactattgatattaccaaggatatggagaagacattagaaatgacagatataaattggagggatgggcacgatctaaggcaagatatcattgattacgaaattgttcagcacatattcgagatattccgtcttacagtacaaatgcgtaacagcttgtctgagttggaagatcgtgactatgacaggttgatatcaccggtcttgaacgagaacaatatattctacgacagcgctaaggcgggagacgctctgcctaaagacgcagatgccaatggggcgtactgcattgccttaaaaggcttatacgagattaaacagatcacagagaactggaaagaggacggcaagttttctagagataaattgaaaatctcaaacaaagactggttcgatttcatccaaaacaaaagatacctt

SEQ ID NO: 38 - DNA, 3789 bp, Artificial Sequence
  Description of Artificial Sequence: Synthetic polynucleotide
atgaacaatggaactaacaacttccagaactttatcggcatctcttccctccaaaagacactgagaaatgcactgatcccaaccgaaacgactcaacaatttattgttaagaacggcatcataaaagaagacgagcttcgcggcgagaaccgccagatacttaaggatattatggacgattattaccgaggctttatcagcgaaactcttagctctattgatgatatcgactggacctccctcttcgaaaaaatggagatacagctcaagaacggcgataataaagacaccttgataaaggaacagactgagtacaggaaagcgatccacaagaaattcgcgaacgacgacaggtttaaaaacatgttctctgcaaaattgatatccgacatcttgccggaatttgtgatacacaacaataactatagcgcttcagagaaagaagagaagacccaagtaatcaagttgttcagccgcttcgcaacgtcttttaaagattactttaagaaccgggccaattgtttctccgcggatgatattagctcatcaagttgccatcgaattgtcaatgataatgcggagatcttcttcagcaatgcgctggtctacagacgaatcgtaaaaagtctttcaaatgacgacatcaataagattagtggagatatgaaggattcccttaaggaaatgagtcttgaagaaatatactcatacgaaaagtacggggaatttattacccaggaggggatctccttctataacgacatctgtggaaaagtaaactcattcatgaacctgtactgtcagaaaaacaaagaaaacaaaaatctgtataaactccaaaaattgcacaagcaaatattgtgtatagcggacacatcatacgaggttccatataagttcgaaagtgatgaagaagtctaccaatcagtgaatgggtttctggacaacattagttccaagcacatagttgaacgactgcgaaagattggtgacaattacaacggctataatttggacaagatttatatagttagcaaattttatgaatccgtatcacaaaagacttatagagactgggaaacaatcaacacggcacttgagatccattataacaatattcttccagggaacggcaaaagcaaggctgataaggtaaaaaaggccgttaagaatgatcttcaaaaatccataacggagatcaacgaacttgtaagtaactacaaattgtgctctgacgacaatataaaggctgaaacgtatattcacgagattagccatatcctgaataactttgaggcccaagaactcaagtataacccggaaatacatttggtagaaagcgagcttaaagcgagtgagctgaaaaacgtcctcgatgtgatcatgaatgctttccactggtgtagtgtctttatgactgaggagttggttgataaagacaataatttctacgctgaactggaagaaatttacgacgaaatctatccagtgatctccctctataacctcgttcgaaactacgtgacgcagaaaccttattctacaaagaaaattaagttgaacttcggcattcctacacttgctgacggatggtccaaatccaaagagtactcaaacaacgcaatcatcctcatgcgggataacctttattatttgggcattttcaacgccaaaaacaaacctgataaaaagataattgaaggcaatacgagtgagaacaagggcgactacaaaaaaatgatatataacttgttgccaggccccaacaagatgattcctaaagtttttctgtcttctaagactggagttgaaacttacaaaccctccgcctacattcttgaagggtataaacagaataagcacataaagtcctcaaaggatttcgacattacgttttgccatgacctcatcgactatttcaagaactgtatcgccatacatccggagtggaagaattttggatttgatttctccgacacatctacctatgaagacataagcggtttctaccgggaggtcgagcttcagggctataagatagattggacatacattagtgaaaaagatatcgatcttctgcaagaaaagggacaactttacctttttcagatttataataaagacttttcaaaaaagtccacagggaacgataatctgcacaccatgtatctcaagaatctgtttagtgaagaaaaccttaaagacatagttttgaagcttaacggagaggctgagattttttttagaaagtcctcaattaaaaaccctataatacacaagaaaggctctattcttgttaacaggacatatgaagccgaggagaaagatcagtttggcaatatccagattgttcgcaagaatatcccggaaaatatatatcaggagctgtataaatactttaacgacaagagcgacaaggagctgagtgacgaggccgcgaagcttaagaatgtagtaggtcaccacgaagcagccaccaatatcgtcaaagactataggtacacgtacgacaagtactttttgcacatgcctataactataaacttcaaagctaataaaactgggtttattaatgacaggattctccaatacatcgctaaagagaaggatctgcatgtaattggcatagacagaggtgagagaaacttgatatatgtcagcgtaatagacacatgtggcaatatcgtggaacagaagtcttttaacatcgtcaatggttacgactaccaaattaagttgaaacagcaggaaggcgcacgacagatcgcacgaaaggaatggaaagagataggcaaaataaaagaaataaaggagggctatctcagtctcgttatacacgaaatttcaaaaatggttattaagtacaatgcaatcatagcgatggaggatctcagttatgggttcaaaaagggtcggtttaaagttgagcgccaagtgtaccaaaagttcgagacaatgctgattaacaagctgaactacctcgtcttcaaagatataagtattacggagaacggtggccttcttaaaggctatcaacttacttacatcccggacaagctcaaaaacgtagggcaccaatgcgggtgtattttctatgtgcctgcggcatatacgtcaaagattgacccaaccacaggattcgtaaacatattcaagtttaaggacctcaccgttgatgcgaaaagggagttcattaaaaaatttgattctattcgatatgatagtgagaaaaatctcttttgtttcacatttgactataataattttattactcagaatactgtcatgagcaagtcatcttggtcagtgtacacatacggggtgcggatcaaacgcaggttcgtcaatggtcgcttctcaaacgaatcagacaccattgacatcacaaaggacatggaaaaaacccttgagatgaccgacattaattggcgcgatggtcatgatctgcggcaagacatcatagactacgaaatcgtccaacacatctttgagatctttcgcttgacggtccaaatgcggaactccctgtccgagctcgaggatagagattatgatcggctgatatctcccgtgcttaatgaaaataacatcttctacgactccgccaaggcgggtgatgccctgccgaaggatgcggatgctaatggcgcttattgcattgctcttaaggggctctatgagataaagcagatcacggaaaactggaaagaagacggtaagtttagtagagacaagctgaagatctcaaataaagactggtttgatttcatacagaacaagcggtacctg

SEQ ID NO: 39 - DNA, 3789 bp, Artificial Sequence
  Description of Artificial Sequence: Synthetic polynucleotide
atgaacaatggcactaacaattttcagaatttcatcggcatttcaagtctgcaaaaaactctgaggaatgctttgatccctactgaaaccactcagcaatttatagtcaagaacggtataattaaagaagatgaactcaggggtgaaaatagacaaatactcaaggacattatggatgactattatagaggcttcatctcagagactctctcatcaatagatgatatcgattggactagccttttcgagaaaatggagattcagttgaaaaatggtgataacaaagatacgttgataaaggaacagaccgagtacaggaaagccattcataagaaatttgctaatgacgatagatttaagaatatgtttagtgcaaaactgattagtgacattctgccggagttcgttatccataataataactactctgcatccgaaaaggaggaaaagacgcaagttattaaactgttcagccgcttcgccacaagcttcaaggactacttcaaaaatagagccaactgcttttctgccgacgatatatcatcatcttcatgccatcggatcgttaacgataacgccgagatattcttcagcaacgcccttgtatatcgaagaatagtcaaaagtctgagtaatgatgatattaataaaattagcggtgatatgaaagactccctgaaggaaatgtcactggaggaaatttatagttacgaaaagtacggcgaattcattactcaagaaggcatatccttctataacgacatttgcggaaaggtcaactcattcatgaacctttattgccagaagaataaggagaataaaaatctttacaaattgcaaaaacttcacaaacaaattctttgcatcgcggatacgtcctacgaagttccttacaaatttgaatccgatgaggaagtgtatcagagtgtcaatggatttttggataatatctcttcaaaacatattgtggagagattgcgcaaaataggtgataactacaatggctacaacctggacaagatttatattgttagcaagttctatgaaagtgtcagtcaaaagacctacagagattgggagacaatcaacacggcgctcgaaatacactacaataacatcctccccggcaatgggaagagtaaagccgataaggttaaaaaagctgttaagaacgacctccagaaatccatcacggaaataaacgagctggtttccaactataagctgtgtagcgatgataatattaaggctgagacatatatacatgagatcagccacattctcaacaatttcgaggcacaggaactcaaatacaatcccgagattcacttggtggaaagtgagttgaaggcgtcagagcttaagaatgtacttgacgtaataatgaatgcttttcattggtgctccgtgttcatgactgaggaactcgtggataaggataataacttttatgcggagttggaagagatatacgatgaaatatacccggttatctcactgtataatctggtcagaaattacgtgacccaaaagccttatagtacaaaaaaaataaagttgaacttcggtattccgacattggcagatggttggtccaaaagcaaagaatactctaataacgccattatattgatgcgagacaatttgtattaccttgggatctttaacgcgaaaaacaaaccggataagaagatcatcgaaggtaatacatctgagaataagggggattacaagaagatgatttataatctgttgccggggccaaacaagatgattccgaaggtctttctgtcatctaagacaggagtagagacctacaaaccttctgcgtacattttggaaggctacaaacagaacaagcatataaaatctagcaaggactttgatatcacgttttgtcatgatctgatagattatttcaaaaactgcatcgctatacatcctgagtggaagaatttcggctttgacttttctgacaccagcacatacgaagacatctcaggtttctaccgggaagtcgagctccaggggtacaagattgactggacatatataagtgaaaaagacatcgacctcctccaagagaagggccaactttacctgttccagatctataacaaagacttttctaaaaagtccacgggtaacgacaacttgcacactatgtatctgaaaaacttgttctctgaagagaacctcaaggacatcgtcctgaagcttaacggggaggcggagatcttctttagaaagtcctctatcaaaaatcccattatccataaaaagggctctatactcgttaataggacatatgaagcggaggaaaaagatcaatttgggaacatccagatcgtccggaaaaatatacctgagaatatctatcaagagctgtacaagtattttaatgataagtcagacaaagagctcagtgatgaggcggcaaagctcaagaacgtggtggggcatcatgaagctgcgacgaacattgtcaaagattatagatacacttacgataaatacttcctccacatgccgataacgattaacttcaaagccaataagacggggtttataaatgatcggatccttcagtacattgcgaaagagaaagacctccatgtgatcggaattgaccgaggagaaaggaatctgatttacgtgtccgtgattgatacttgcgggaatatagtcgagcaaaagagtttcaacatagtcaacgggtatgactatcagataaagctcaaacagcaggaaggtgcgaggcaaattgcgcgcaaagagtggaaggagataggcaagattaaagaaatcaaggaaggttatctcagcttggtgatccatgaaatatctaagatggttataaagtacaatgccataatagccatggaggatctttcctacgggtttaagaagggccgatttaaagtggagcgacaagtttaccagaagttcgaaaccatgttgattaacaaacttaactatttggtgttcaaggatataagtataaccgaaaacggcggtttgcttaagggttatcagctcacgtatattcctgataaacttaaaaacgttggacaccagtgtggatgtatcttctacgtgccagccgcttacactagtaagatagatcctaccacggggtttgtgaatatttttaagtttaaagacttgacagtcgacgccaaaagggaatttataaaaaagtttgattctatccgctacgatagtgaaaaaaatctcttttgctttactttcgactataacaacttcattacgcagaacactgtcatgagtaagtccagctggagcgtctacacatatggcgtccgaattaaacgacgatttgtaaacgggcggttttcaaacgaatctgacacgatagacattaccaaggatatggagaagacacttgagatgaccgacataaactggcgggacggtcacgatcttcggcaggacataattgattacgaaatcgtccagcatatattcgaaatatttcgacttacagtgcaaatgcggaacagtctctctgaactggaagatcgcgattatgaccggttgatttctccggtcctcaatgaaaataacatattttatgatagtgctaaggcaggtgatgcgttgccaaaggatgcagacgctaatggtgcctattgtatcgcgctcaagggattgtacgagataaagcaaattacggagaactggaaggaggatggtaagtttagccgagacaagttgaagattagcaataaagactggtttgattttatccaaaacaagaggtacctg

SEQ ID NO: 40 - DNA, 3789 bp, Artificial Sequence
  Description of Artificial Sequence: Synthetic polynucleotide
atgaataacggaactaataactttcaaaatttcataggtatttcaagcttgcagaagaccctgaggaatgccctgattccaaccgagacaacgcagcagttcatagtcaaaaatggcattattaaggaagatgagctgcggggggaaaaccgacagatactcaaggatattatggacgactattaccggggatttatctcagaaacgctgagcagtattgatgacatcgattggaccagtcttttcgagaaaatggaaattcaacttaagaatggtgacaataaagacactctcataaaggagcaaactgaataccgaaaagccatacacaaaaagtttgccaacgatgaccgctttaaaaacatgttttcagctaagctcattagcgacattctccccgagtttgtgattcataacaataactatagcgcatccgagaaggaggaaaaaacccaagttatcaaattgttcagtagattcgctacgagctttaaagattactttaaaaaccgggctaactgcttcagtgcagacgatatcagctcctcatcctgtcatcgcatcgtcaatgataatgctgagatcttcttttctaatgcactggtttaccgcaggatagttaagtctcttagtaacgacgacatcaacaagatatcaggagatatgaaggattcccttaaagaaatgagtctcgaggagatatattcttatgaaaaatacggcgaatttattacccaagagggcattagtttctataatgacatatgcggaaaagttaatagttttatgaatctctattgtcagaagaataaggagaataagaacctctacaaattgcagaagttgcacaagcaaattctgtgtatcgcggacacctcttacgaggtcccatataagttcgagagtgatgaagaagtataccagagcgttaatgggttcctggacaacatctcaagtaaacacatagtcgaaaggctccgaaagatcggtgataactataacggatataatttggataaaatttatatagttagcaaattttacgagagcgtcagtcagaagacctaccgggactgggagaccataaacacagcgctggaaatacattataacaacatactgcctgggaacggtaagtcaaaggcagacaaggttaaaaaggctgtgaagaatgacctgcaaaaatcaattacagaaataaatgagttggtaagtaattacaaactttgcagcgatgataatataaaggcagagacgtacatacatgaaatatctcatatcctcaacaatttcgaagcccaagaactgaagtacaacccggaaattcatcttgtagagtctgagttgaaggcctccgaattgaaaaacgttcttgacgtaattatgaatgccttccactggtgctcagtattcatgacggaagagctcgtggataaagacaacaatttttacgctgaactggaagaaatatatgacgagatttaccccgtaatttcactctacaacttggtacgaaattacgttacccaaaagccatactcaacaaaaaaaattaaactgaacttcgggatacccaccctcgcagatggatggtcaaagtccaaagagtacagtaacaatgcaattatcctgatgcgagacaacctttattacctcgggattttcaacgctaaaaataaacctgataaaaaaataattgagggtaatacctctgaaaacaagggggattataaaaagatgatatacaatctgctgcctggcccgaacaaaatgattcctaaagtcttcttgtcttccaagactggagtcgaaacctacaagccaagtgcttatatactcgaagggtacaaacaaaataagcacataaaatccagcaaggattttgatattacattctgccacgatttgattgattattttaagaactgtatagccatccacccagaatggaagaattttggttttgattttagcgatacctcaacatatgaggatatctctggcttttaccgcgaggtagaactgcaaggttataagatcgattggacttatatttctgaaaaggacatagatctcctgcaagagaaagggcaactttatttgtttcaaatatacaacaaagattttagtaagaagagtactggcaatgataaccttcacactatgtatctgaagaaccttttttctgaggagaacttgaaggacatagtccttaaactcaatggggaagctgaaatattctttcgcaaaagctccattaaaaacccgatcattcataaaaagggttccatcttggtaaaccgcacatacgaggcggaagaaaaagatcagttcggaaatatccagatcgtaaggaagaatatccccgaaaatatataccaagagctttacaaatattttaacgataagtcagacaaggaactgtcagacgaagcagccaagttgaagaatgtcgtagggcaccacgaagcagctacaaacatagttaaagattatcggtacacctacgataaatatttcctgcatatgccaataaccataaacttcaaagccaacaaaacagggttcatcaatgaccgaatacttcagtatatagccaaggaaaaagacctgcatgttataggaatagatagaggtgagcgcaacttgatatatgtcagcgtgatagacacctgcggaaatatcgtcgagcaaaaaagtttcaacattgttaatggctacgattaccaaattaaattgaagcagcaagagggggctcggcaaatcgcgcgaaaggaatggaaagaaatcgggaagattaaagaaattaaagagggctacctgtctcttgtaattcacgaaatatctaagatggtcatcaagtataatgccattattgcgatggaagatctgtcctacggatttaagaaaggcaggtttaaagtcgaaaggcaggtgtaccagaaattcgagaccatgctgattaataagctcaactatctcgtatttaaggatatttctataactgaaaatggagggcttctcaaaggatatcaactcacatacatacctgataagctgaagaacgtaggccaccagtgtggatgcatattctatgtaccagctgcatacacaagcaagatcgatccaactactgggtttgtcaatatcttcaaatttaaggacttgacggtcgatgccaaacgggagttcatcaaaaagtttgatagtattcgatatgatagtgagaagaacttgttttgcttcacatttgactacaacaatttcataacgcaaaatacggttatgtctaaatcctcatggagcgtctacacttacggagtgaggataaagcggcgcttcgtaaatggcaggtttagcaatgaatccgacacgattgacataaccaaggatatggagaaaaccctcgagatgaccgatataaattggcgggatggacacgatctgcgacaagacataatcgattatgaaatcgtgcagcacatatttgagatattcaggcttacggtccaaatgagaaattccctttccgaacttgaagaccgcgattacgaccgactgataagccccgttctgaacgaaaataacatcttctacgacagcgctaaagcgggagacgcgctgccgaaagatgcggacgcaaatggagcctattgtatcgccttgaaagggttgtacgagatcaaacagataaccgagaattggaaggaggatgggaagtttagtcgagacaaacttaaaataagcaacaaggactggttcgactttattcaaaacaaacgatatctc

SEQ ID NO: 41 - DNA, 3789 bp, Artificial Sequence
  Description of Artificial Sequence: Synthetic polynucleotide
atgaataatggtactaacaattttcaaaactttatcggcatctcttcacttcagaaaactcttcggaacgcccttataccgacggagacaacgcagcagtttatagttaaaaacgggatcattaaagaagatgaactcagaggggaaaacaggcaaatattgaaggacattatggacgattactaccgggggtttatttcagagaccctttcatctattgatgacatagattggacctcccttttcgagaaaatggagatacaattgaaaaacggcgacaataaagatacacttatcaaggaacaaactgagtatcgcaaggcgattcacaagaagtttgcgaatgacgatcgctttaagaatatgttttctgcgaagctcataagtgacattctgcctgaatttgtcattcataacaacaattattctgctagcgaaaaagaggaaaaaactcaagtcattaagctttttagcaggttcgctactagttttaaagactattttaagaaccgggcgaattgctttagcgctgacgacatatcatcctcatcctgtcatcgcatagtcaatgataatgcagaaatattcttttctaatgcgctcgtgtatcggagaatagtgaaaagcctctctaacgatgacattaacaaaataagcggcgatatgaaggatagtctgaaggaaatgtccctcgaagaaatatactcatacgagaagtacggagaatttatcacccaggaaggaattagtttttacaacgacatctgtggtaaggttaactcttttatgaatctgtattgtcaaaagaataaagaaaataaaaatctttataagctccaaaagcttcacaaacaaatcttgtgcattgcggatacgtcatacgaagtaccttacaaatttgaaagcgacgaagaggtgtatcagtcagtgaatgggttccttgacaatatttctagcaaacatattgtggagcgacttcgaaagatcggtgataattacaatggctataatttggataaaatttacatagttagtaagttttatgaatccgtctcacaaaagacgtaccgagattgggagaccatcaacactgctctggagattcattacaataatatattgcctgggaatgggaagtcaaaggccgacaaggttaaaaaagccgtaaaaaacgatcttcaaaagtccattaccgagataaatgaacttgtatccaactataagttgtgctctgacgataatattaaagcagaaacgtatatccacgaaataagtcacatcctgaacaacttcgaagctcaagagctcaagtataatcctgaaattcatctcgtcgaaagcgagctgaaagcatccgagttgaagaatgtgcttgatgtgatcatgaacgcattccattggtgcagtgtgttcatgaccgaagaacttgtagacaaagacaacaacttctacgctgaattggaagagatttacgatgaaatttaccccgtgatatccctctataatctggtaagaaattacgtcacgcaaaaaccatacagtaccaagaaaataaagctcaactttggtattccgacgttggcagatgggtggagtaagagcaaggagtattctaacaatgcaatcatcctcatgcgcgacaatttgtattatctggggatcttcaacgcgaaaaataagcccgacaaaaagataatagaaggcaatacgtccgagaacaaaggggactataagaaaatgatttataaccttcttccaggacccaacaagatgatcccaaaggttttcttgagttcaaaaaccggcgtagaaacttataaaccgtccgcctacattctggaagggtacaagcaaaacaagcacattaagtcatctaaggatttcgacattactttttgtcatgatttgatagactacttcaaaaattgtatagcgatacatccggaatggaaaaattttgggttcgatttttccgacacaagtacttatgaagacatctcagggttttatagggaagttgaactgcaaggttacaaaatagactggacttatattagtgagaaggacattgatttgctccaggaaaagggtcaattgtatctgttccagatatataacaaggatttctctaaaaaatctacaggtaacgacaatctccacacgatgtacctcaagaatctcttcagcgaagagaatttgaaggatatcgtacttaagctcaatggagaagcggaaatattcttcagaaagtccagcattaagaatcctataattcacaagaaagggtcaattctcgtaaaccggacttatgaggccgaagaaaaagatcagtttggtaacattcagattgtacggaaaaacattcccgagaacatctatcaagaactgtataaatactttaatgataaatccgacaaggaactttctgacgaggctgcaaaattgaagaacgtagtgggacaccatgaggccgcaaccaatatagtaaaggattacagatacacttatgataagtatttcctccatatgccgatcacgattaatttcaaggcgaataaaaccggcttcattaacgatcgcattttgcaatatattgcgaaggaaaaggatttgcacgtgataggtatagaccggggtgaacgaaacttgatttacgtctctgtgatcgacacatgcggaaatatagttgaacagaagtcctttaatattgtgaatggttacgactaccagataaaattgaagcaacaggagggcgcaagacagatagctcgcaaagagtggaaggaaatcggcaagatcaaagaaataaaggagggttatctttccctggtaattcatgaaattagcaagatggttattaagtataatgctataatagctatggaggacctttcctatgggttcaagaaaggtcgcttcaaagtggagcgacaagtgtatcaaaagttcgagactatgttgataaataaattgaattatttggtttttaaagacatttcaataactgagaacgggggtctcttgaaggggtaccaattgacttatattccggacaagttgaagaatgtcggacaccagtgtggttgcattttctacgtgcctgccgcttacacctcaaaaatcgatccgaccactggttttgtaaatatatttaaattcaaagatctcaccgttgatgccaaacgggagtttatcaaaaaattcgattccattcgctacgactctgagaaaaaccttttttgtttcacgttcgattataacaactttataacccaaaatactgtaatgtccaagtcaagttggtctgtctatacttacggagtaaggatcaagcgccgcttcgttaatgggagattctcaaacgagtctgataccatagacataactaaagacatggaaaaaaccctggaaatgacggacatcaattggcgagacgggcatgatcttcgacaggacataatagattacgaaattgttcaacacattttcgagatatttcgacttacggttcagatgaggaattccctttccgaattggaagaccgggattatgatcgacttatatctcccgtgctcaatgaaaacaatattttttatgattcagcgaaagctggggacgcgctgccaaaagatgccgatgccaatggagcatactgtatcgccctgaagggtttgtatgagattaagcaaattactgaaaactggaaggaagatggcaagttttctagagataagcttaagattagcaataaggactggtttgacttcattcaaaataaaaggtatctt

SEQ ID NO: 42 - DNA, 3789 bp, Artificial Sequence
  Description of Artificial Sequence: Synthetic polynucleotide
atgaataatggaacaaataattttcaaaattttattggtatcagttcattgcaaaagactttgagaaatgctttgatcccgactgagaccacacagcagttcatcgtcaaaaatggcataatcaaggaagacgaacttaggggtgagaatagacaaatattgaaggacatcatggatgactattatagggggttcatttccgaaacgctcagtagtattgatgacattgactggactagtcttttcgagaaaatggaaattcagcttaagaacggggacaataaagacacgctgatcaaggagcaaacggaatataggaaggcgatccataaaaaattcgcgaatgatgatcggtttaaaaacatgtttagtgccaagttgatcagcgacatactgcccgaattcgtgatccacaacaataattacagcgcctccgaaaaggaggaaaaaactcaggtcattaaattgtttagccgattcgcaacgagtttcaaagattattttaagaaccgggccaactgtttttcagcggatgatattagctccagcagctgccatcgcatagtaaatgataacgctgaaatcttttttagcaacgcacttgtctaccggaggattgtaaaatcactgtcaaatgatgacattaacaaaatatctggagatatgaaggactcactcaaagaaatgagcctggaagaaatatattcatacgaaaaatacggggagtttattacccaggaaggtatcagtttttataatgatatatgtggaaaagttaattcatttatgaatctttactgtcaaaaaaataaggagaacaagaatttgtacaagctccaaaaacttcataaacagattctgtgcatcgcagacacaagttatgaggtaccgtacaaatttgagagcgacgaagaagtttatcagagtgtgaatggtttcctggacaatatctcttctaaacacattgttgagaggcttaggaagatcggtgataattataacggctataatctggacaaaatttatattgtatcaaagttttatgaatcagtctctcaaaagacgtatcgggattgggaaacaattaacacggctctggagatccactacaataacattctgcccggcaacgggaagagcaaagctgataaggtcaagaaggcagtcaagaacgaccttcagaagagcataacagaaattaacgaattggtcagtaactacaaactgtgtagtgatgacaacataaaagccgaaacatacatccatgaaataagccatatcctgaataacttcgaagcccaagaacttaaatacaatcccgagattcatcttgtcgaatcagaactcaaggcgtccgagctcaaaaatgtccttgacgtgataatgaatgccttccactggtgcagcgtattcatgacggaggagttggtagataaagacaacaacttttatgccgaattggaagagatttatgatgagatttaccccgttatttctctgtacaacttggttcgaaactacgtaacacaaaaaccatactcaaccaaaaagatcaaactcaattttggcatacctacattggctgatggttggtccaagtcaaaggaatatagcaataatgcaataattctcatgcgagataacttgtattatttggggatctttaacgctaagaacaaaccagataaaaagataatcgaggggaacacaagtgagaacaagggtgattacaaaaaaatgatttacaatctgcttcctgggcctaacaaaatgattccgaaggtgtttcttagctctaaaactggagtggagacgtataagccttccgcgtacattctcgaaggctacaagcaaaataagcatatcaagtccagtaaggacttcgacatcactttttgccacgatctcatcgattactttaagaactgtatcgcaatacaccccgagtggaaaaactttggttttgatttttcagacactagtacctacgaggacatttccggcttctatcgagaagtcgaactccagggctacaaaatcgattggacgtacatttctgagaaggacatcgacttgctccaagagaaaggtcaactttacctcttccaaatttacaataaagacttttcaaagaagagcaccggtaatgacaacttgcataccatgtatctgaagaacctgttttctgaggagaacctcaaggatattgtattgaagttgaatggcgaagcagaaatatttttccgaaagtcatctatcaagaaccccattatacacaaaaaaggctctatcctggtgaaccggacttacgaggcagaggagaaggatcaattcggaaacatacagatagtccgcaaaaacatccctgagaatatctatcaggaactctataagtacttcaatgataaatcagacaaggagcttagcgacgaagcagctaaacttaaaaacgtggttggccatcacgaggccgctaccaacatagtcaaagactaccgctatacttatgacaagtactttttgcacatgcccataacaattaatttcaaagctaacaaaacagggtttataaatgacagaatcctccaatacatcgccaaagagaaggacctccatgtaatcgggattgatagaggcgaacggaacttgatttacgttagtgtcattgatacctgtggtaacattgtcgaacaaaagtcattcaacatagtcaatggatatgattatcagataaaactcaagcaacaagaaggcgcgaggcagattgccaggaaggaatggaaagaaatcgggaagatcaaggagatcaaggagggttacctgtccttggtgatacacgagatttcaaaaatggttataaaatacaatgccattatcgcgatggaggatttgtcttatggatttaagaaggggaggttcaaagtcgaacgacaagtctatcagaagtttgaaacaatgctcattaacaagctcaattaccttgttttcaaggatataagcatcactgaaaacggcggactccttaagggatatcagctgacttatatccccgacaagctcaagaacgtagggcaccaatgcggatgcatcttttacgtgcctgcagcatatacttcaaaaattgatccgactactggctttgttaacattttcaagttcaaggatctgacggtagacgctaagagagaattcataaaaaagtttgacagcatcaggtacgatagtgaaaagaaccttttttgttttacctttgactacaataattttattacgcaaaatacagttatgagcaaatcaagttggagcgtttacacatatggcgttcggatcaagcgcagattcgtcaatggtcgcttctcaaatgagagcgatacaatcgatataacgaaggatatggagaagacgcttgagatgacagatatcaactggcgggacggacatgaccttagacaagacataatcgattacgaaatagtacagcatatctttgagatttttaggcttacagttcagatgcggaactctctttccgaactggaggaccgggattatgatcggttgatctccccagtactgaacgaaaataatatcttttacgatagcgcgaaggctggtgatgcactcccaaaagacgctgatgcgaacggagcttattgcatagcccttaaagggctttacgagattaaacaaataacagaaaattggaaggaagatggcaaattttcccgcgacaagttgaagattagtaacaaagactggttcgacttcattcagaataaacgctacctc

SEQ ID NO: 43 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaataacggtaccaataacttccagaacttcatcggtatttctagcctgcaaaagaccctgcgtaacgcgctgattccgaccgagactacccagcaattcatcgtgaaaaacggtatcattaaggaagatgaattgcgcggtgagaatcgtcagattctgaaagatatcatggatgactactatcgcggtttcattagcgaaaccctgtcgagcatcgatgatatcgattggacgagcctcttcgagaaaatggaaattcaactgaaaaatggtgacaacaaagataccctgattaaagaacaaacggaataccgcaaggcaatccataaaaagtttgcgaatgacgaccgttttaagaatatgttctcggccaagctgatttccgacatcctgccagagttcgtcattcacaacaacaattacagcgcaagcgagaaagaggaaaagactcaggtcattaagctgtttagccgctttgcgacgtccttcaaagactacttcaagaatcgtgcgaattgctttagcgcggatgacatctctagctctagctgtcaccgtattgttaacgacaatgcagagattttcttcagcaacgccctggtgtatcgccgtattgtcaagtctctgagcaacgacgacattaacaagatcagcggcgacatgaaagacagcctgaaagaaatgtctctggaagaaatctacagctacgagaaatatggtgagtttatcacccaagagggcattagcttctacaatgatatctgtggtaaggttaatagctttatgaatctgtactgccagaagaataaagaaaacaagaacttgtacaagctgcaaaagctgcataagcaaattctgtgcatcgccgatactagctatgaagttccgtacaagttcgagtctgatgaagaggtgtatcagtcagtcaacggttttctggataacatcagcagcaagcacatcgtcgagcgcctgcgcaagattggtgacaactacaatggttataacctggacaagatctatatcgtgtcgaagttttacgagagcgtgtcccagaaaacgtaccgtgattgggaaacgattaacacggccttggaaattcactataacaatatcctgccgggcaacggcaagagcaaagctgacaaagtcaaaaaagctgtgaaaaacgatctgcaaaagtccatcaccgagatcaacgaactggttagcaactataagctgtgtagcgacgacaacattaaagctgaaacgtatatccacgaaatcagccacatcctgaataactttgaggcacaagaactgaaatacaatcctgagatccatctggtagagagcgagctgaaggcaagcgagttgaaaaacgttctcgacgttatcatgaatgctttccactggtgtagcgtgtttatgaccgaagaactggttgacaaagataacaatttctatgcagagctggaagaaatctatgatgaaatctacccggtcatcagcctgtataacctggttcgtaactacgtgacgcagaagccgtacagcaccaaaaagatcaagctgaacttcggtattccgaccttggcggacggttggagcaaatccaaagaatactccaataatgcgattattctgatgcgtgataatctgtactatctgggtatcttcaatgcgaagaacaagccagataaaaagattattgaaggcaacaccagcgagaataaaggcgactacaagaaaatgatctacaacttattgccgggtccgaacaagatgatcccgaaagtttttctgagcagcaagaccggcgttgaaacctataagccgagcgcgtacattttagagggctataaacaaaacaagcacatcaagagcagcaaagattttgatattacgttctgccacgacctgatcgactatttcaagaattgtattgcgattcaccctgagtggaagaacttcggttttgacttttccgatacctccacctatgaagatattagcggtttttaccgtgaagtcgagttgcagggttataagattgattggacttacatttccgagaaagacatcgacctgttgcaagagaaaggtcagctgtacctgtttcagatctataacaaagatttcagcaaaaagtcgacgggcaatgataatctgcacaccatgtatctgaaaaacctgtttagcgaagagaacctgaaagacattgttcttaagctgaatggtgaggccgagatcttcttccgtaaaagctccattaagaacccgattatccacaaaaagggctctattctggttaaccgcacgtacgaagcggaagagaaagatcaatttggtaacatccagatcgtgcgtaagaatatcccggagaacatttaccaagaactgtataagtatttcaatgacaagagcgataaagaattgagcgatgaagcggcaaagctgaaaaacgtcgttggccaccacgaagccgcgacgaatatcgtgaaagattatcgttacacctacgacaagtactttctgcacatgccgatcaccatcaatttcaaagcgaataaaacgggttttatcaatgaccgtatcctgcagtacattgcgaaagaaaaagatttacacgtgattggtattgatcgcggcgagcgcaatctgatttacgtcagcgttatcgacacgtgcggcaatattgtggagcagaaaagcttcaatatcgtcaatggttacgactaccagatcaaactgaagcaacaagagggcgcccgccagattgcgcgtaaagagtggaaagaaatcggtaagattaaagaaatcaaggaaggctacctgtccctggtgatccatgaaatcagcaaaatggtgatcaagtacaacgctatcattgcgatggaagatctgagctacggttttaaaaagggtcgcttcaaagttgagcgtcaagtgtatcagaaatttgagactatgctgattaacaagttgaactatctggtttttaaagacatcagcattaccgagaatggtggcctgctgaagggttatcaactgacctatattcctgacaagttgaaaaatgttggtcatcagtgtggttgcattttctacgtaccggcagcgtacacgagcaagattgacccgaccacgggtttcgttaacattttcaagtttaaagatttgaccgtggacgccaagcgtgagttcattaaaaagttcgacagcatcagatacgactctgagaagaatctgttctgctttacgttcgactacaataacttcattacccaaaataccgttatgagcaaaagctcctggagcgtgtacacgtacggcgtccgtatcaagcgtcgttttgtgaatggtcgcttttccaacgaatctgacaccattgacattaccaaagatatggaaaagacccttgagatgaccgacattaattggcgtgatggccatgacttgcgccaagacattatcgactacgaaattgttcagcacatctttgagatttttcgtctgacggtccagatgcgcaactcgctgagcgagttggaagatcgtgactatgaccgtctgattagcccggtgctgaatgaaaacaatatcttctatgatagcgcaaaggccggtgacgcgctgccgaaagatgcggatgctaacggtgcatactgcattgcactgaagggtctgtacgaaatcaaacagatcaccgagaattggaaagaggatggtaagtttagccgtgataagctgaagattagcaataaagactggttcgactttattcaaaacaagcgctatctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 44 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaacaacggaacaaataattttcagaactttattgggatcagttcgcttcagaaaacgcttcgtaatgctctgattcccacagaaaccactcagcagtttatcgtaaagaatggcattatcaaggaggatgaattacgcggcgagaaccgccaaatcttaaaagatatcatggacgactactaccgcggtttcattagcgaaactcttagttcaattgacgacattgactggacgtccttgttcgaaaagatggagattcaattaaagaacggtgataacaaggatacgttgattaaagaacagacggagtaccgtaaggctatccacaaaaaatttgcaaacgacgaccgctttaaaaatatgtttagcgcaaaattaatctccgacatcctgcctgaattcgtcatccataacaataactatagcgcctcggaaaaagaagaaaaaacgcaggttattaaacttttctcgcgctttgcaacaagctttaaggattacttcaaaaatcgcgccaattgtttttcagccgacgacattagctccagttcctgccaccgtattgtgaatgacaacgctgagatttttttttccaatgcgctggtttatcgtcgtattgttaagagccttagtaacgacgacattaataaaattagcggtgatatgaaggatagcttgaaagaaatgagtctggaagagatctatagttacgagaagtacggcgaatttattacccaggagggcatttcattttacaatgatatctgtggaaaagtcaactcctttatgaacttgtattgccaaaagaataaagaaaacaaaaacctgtacaaactgcaaaagttacacaagcagattttgtgtatcgcagacacgtcatacgaagtaccgtacaagtttgagtccgatgaagaagtgtaccaaagcgttaatggctttttggataacatttcgagcaaacatatcgtagagcgtttgcgtaagattggtgataattacaacggttacaatttagacaaaatctatatcgtctctaagttttacgaaagtgtttctcagaaaacttaccgcgattgggagacgatcaacactgcgctggagattcattacaataatatccttccaggtaacggtaaaagcaaagctgataaggtgaaaaaggcggttaaaaatgaccttcaaaagtctatcacagaaatcaacgaattggtcagcaattataagctttgcagtgacgataacattaaggccgagacttacatccatgagatctctcacattcttaataattttgaagcgcaagagctgaaatacaatcctgaaatccatctggtcgaaagtgaattaaaagcctccgaattaaaaaatgtcttggacgtgatcatgaatgcgttccattggtgctcagtttttatgacggaagagttggtggacaaagacaacaatttttacgccgagcttgaggaaatttacgacgaaatttaccccgttatttcgttatacaaccttgtgcgtaattacgttacacaaaagccctattcgacaaagaaaatcaagttaaatttcgggattcccacattagctgatggatggtccaaatccaaagaatactcgaataacgctatcatccttatgcgtgataatttgtactacttaggcatcttcaatgcgaagaacaaacctgacaagaaaattatcgaaggaaacacttcggagaacaaaggtgattataaaaagatgatctacaacttgcttcccgggccaaacaaaatgattcccaaggtatttttgagttctaaaaccggtgtcgaaacttacaaaccaagtgcttatattttggaaggatacaaacagaacaaacatatcaagtcttcgaaagacttcgatattacgttctgccacgatctgatcgattacttcaagaactgtattgctattcaccccgagtggaagaactttggatttgatttctccgacacgtccacttatgaagatatctctggcttctatcgcgaggttgaattacaagggtataagattgactggacttatatttcggagaaggatatcgatcttttgcaagaaaaagggcaactttatttatttcagatctataacaaggacttttcaaaaaagagcactggaaatgacaatctgcataccatgtaccttaagaacctgttctcggaagagaacctgaaggacattgtacttaaactgaatggagaggcagagatcttctttcgcaaatcaagcattaagaacccaattattcacaaaaaggggagtatcttagtaaatcgcacatatgaggctgaggaaaaagatcagtttggtaacattcagatcgtgcgtaagaacattcctgaaaatatctatcaggaactttataagtatttcaacgataaaagtgataaagagctgagtgacgaagcggctaaacttaagaatgttgtgggacaccatgaggcagcaaccaatattgtgaaggattatcgctatacgtacgacaaatactttttacacatgcccatcactattaattttaaagctaataagactggcttcattaacgatcgcatcctgcagtacattgctaaggaaaaggatcttcacgttatcggtatcgatcgcggggagcgtaatcttatctacgtctctgtcattgacacgtgtggcaatattgtggagcaaaagtccttcaatattgttaacggctatgactatcagattaaattgaaacagcaggaaggtgcgcgtcagattgcccgcaaggaatggaaggaaattggcaagatcaaagaaattaaggagggctacttaagcttagtaattcacgaaattagtaaaatggttatcaaatacaacgccatcatcgcgatggaggatctttcgtacgggtttaagaaaggtcgttttaaagtggagcgtcaggtgtaccagaaatttgaaactatgcttattaacaaacttaactacctggttttcaaggatatcagtattactgaaaacggggggctgttaaaagggtatcaattaacttacattccagacaaattaaagaacgttggacatcagtgtggctgcattttttatgtaccagctgcatacacttcaaagatcgatcctacgactgggttcgtgaacatttttaagtttaaagacttgacggtagatgccaagcgcgaattcatcaagaaattcgacagcattcgctacgactctgagaaaaatcttttctgtttcacattcgattataacaatttcattacgcagaacacagtaatgtccaagtcttcttggagtgtttatacatatggtgtccgcattaagcgccgtttcgtcaacggccgcttcagtaatgagagcgatactattgacatcacaaaagacatggaaaaaacactggaaatgaccgacatcaattggcgtgacggccatgacttacgtcaggatatcattgattatgagatcgttcaacacatcttcgaaatctttcgcttgactgttcaaatgcgcaattccttgtcggaattggaggaccgtgattatgaccgcttaatttcccccgtcttaaatgaaaacaatattttttatgactctgcaaaagctggagatgctctgccgaaagacgccgatgcaaatggggcatattgcattgctttaaaggggctttacgagatcaagcaaatcaccgaaaactggaaagaggatggaaagttttcgcgtgataaactgaagatctctaacaaagactggttcgactttatccagaacaagcgttatttgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 45 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaacaacggcaccaataacttccaaaacttcatcgggatctctagccttcagaagacgcttcgcaatgctcttatcccaactgagaccactcaacaatttattgtgaagaatggaattattaaagaggacgaactgcgtggcgagaatcgtcagatcttaaaggacattatggatgattattaccgtggattcatctccgaaacattatcgtcgatcgatgatatcgattggacttctctgttcgagaaaatggaaattcaattgaaaaacggagataataaagatacgcttatcaaagaacagacggaatatcgtaaagcgattcataagaaattcgcaaatgacgatcgtttcaaaaatatgttcagtgccaagcttatttcggacattttacctgaatttgtaattcataataataactactcagcaagtgagaaggaggagaaaacccaagttattaaactgttctctcgtttcgcaacgtcctttaaagattactttaaaaaccgcgcgaattgctttagcgctgacgacatttccagctcatcctgtcatcgcatcgtaaacgacaatgcggaaatcttcttcagcaacgccctggtttaccgccgcatcgtcaaaagcttatcgaatgacgacatcaataagatctcaggagatatgaaggactcgcttaaggagatgtctctggaggaaatttatagttacgaaaagtatggagagttcattacccaggagggaatctcgttctacaatgacatttgcgggaaggtgaactccttcatgaacttatactgccagaaaaacaaagagaacaaaaatctgtataaattgcagaaattacataaacagattctttgtattgctgacacttcctacgaagtaccctataaattcgagtcagatgaagaagtataccagtccgtgaacggatttctggacaatatctcctcaaaacacatcgtggaacgcttacgtaaaattggcgataattataatggttacaatcttgacaaaatttatatcgtatctaaattttacgagagtgtgagccaaaagacctaccgcgactgggagaccatcaacacagctttagaaattcactataataatatcttacccggcaatggtaagagcaaggctgacaaggtaaaaaaggccgtcaagaatgatttgcagaaatctattacagaaattaatgagttagtctccaactataagctttgttccgacgataacatcaaagctgagacatatattcatgagattagtcacattcttaacaacttcgaggcccaggaacttaagtacaatcctgaaattcatcttgtcgagtctgagctgaaagctagtgaattgaaaaatgttttagacgttattatgaacgcattccactggtgctctgtgtttatgacagaagaactggtcgacaaggacaataacttctatgccgaacttgaggaaatctacgatgaaatttaccctgtaatctccttgtataatcttgtacgtaattacgtcactcaaaaaccttacagcacgaaaaaaattaaattgaacttcgggattcctacacttgccgacgggtggtctaaatccaaggaatatagcaacaatgccattattttaatgcgcgacaatctttactatttaggaatttttaacgctaagaacaagcccgataaaaagattattgaaggaaacacgtctgaaaataagggcgactacaaaaagatgatttataaccttttgcccggtccaaacaaaatgatcccaaaggtattcctgtcatccaaaacaggggttgagacatataagcccagcgcatatattctggaaggatacaaacagaataaacatatcaaaagcagcaaagattttgacattactttttgccacgatttaatcgactacttcaaaaactgtatcgctatccaccctgaatggaagaatttcggatttgatttctcagatacaagtacgtatgaggatatcagcggtttctatcgcgaagttgaacttcaagggtataaaattgactggacctacattagtgagaaggacatcgacctgttacaggaaaaaggccaattgtacttgtttcagatctacaataaggatttctcaaaaaaatcgaccggcaatgataacttgcacaccatgtacctgaagaaccttttttcggaggaaaaccttaaagacattgtcctgaagttgaatggagaagcggagattttctttcgtaagtcttccattaaaaatccaattattcataagaagggcagcatccttgtgaaccgtacgtacgaggcggaagagaaggaccaattcggtaacattcaaatcgtccgcaagaacatccctgaaaatatttatcaggagctttacaagtatttcaatgataagtccgacaaggaattatcagatgaggctgcgaagttgaaaaatgttgttggtcatcacgaggcggcgacgaatattgtaaaggattatcgctacacttatgacaagtactttctgcacatgccgatcaccattaatttcaaggcgaacaaaacaggatttattaatgaccgcatcttacaatacattgccaaagaaaaggacttacacgttattggcattgatcgtggagaacgcaacttaatctacgtaagcgttattgacacttgcgggaatatcgtagaacaaaagagcttcaacatcgtgaatggttacgattaccagatcaagcttaagcagcaggagggagcgcgccagatcgcgcgcaaggaatggaaggagattggtaagatcaaggaaatcaaggaaggttatctgtccttggtaatccacgaaatttcgaaaatggttatcaaatacaatgctattattgcaatggaggacttgtcctacggctttaaaaaaggacgctttaaggtggagcgccaggtttatcaaaagtttgaaacaatgctgattaacaagctgaactatttggtctttaaagatatctccatcaccgaaaatggtgggcttttgaaaggctatcaacttacatatatccctgataagcttaagaatgtgggtcatcagtgcgggtgcattttttatgttcctgcagcctacacgtccaaaatcgatcctacaactggatttgttaatatcttcaaatttaaggatcttaccgtcgacgcgaagcgcgaatttatcaagaaattcgatagtattcgttatgattccgaaaaaaaccttttctgtttcacctttgattataataactttatcacgcaaaatactgtcatgagcaaatcgagttggtctgtgtacacttacggagtacgcatcaagcgtcgttttgttaatgggcgcttcagtaacgagtcagacacgattgatatcacaaaagatatggagaaaacgctggagatgacagacatcaattggcgcgatggtcatgacttacgtcaagacattatcgattatgaaattgtccagcatatctttgagatctttcgtttgactgttcagatgcgcaacagcctgtcagaattggaggatcgtgactatgatcgccttatttctcccgtcttaaatgagaacaatatcttctacgactcagccaaggctggagatgcactgccaaaagacgccgacgcaaatggggcctactgtattgcattgaaggggttgtacgagatcaaacagattacagaaaattggaaggaggacggtaagttctctcgtgataagctgaagatttctaacaaagactggttcgatttcattcagaacaaacgttacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 46 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaacaacggtaccaataactttcagaatttcattggaatcagcagcttacagaaaaccctgcgcaatgcacttatccccactgagacaacccagcagttcattgtaaagaacgggattattaaagaagatgagcttcgcggggagaatcgtcagatcttaaaggatattatggacgattactaccgtggcttcatttcggagacgctgtcgtcgatcgacgacatcgactggacatccttgtttgaaaagatggaaatccaactgaagaatggcgataacaaggacacgttaatcaaagagcagacggaataccgtaaagctatccacaaaaagttcgctaatgacgaccgctttaagaacatgttctcagcaaaacttattagcgatattttacctgaatttgtcatccacaataacaattactccgcgagtgaaaaagaggagaaaacccaggtgattaagctgttttcccgttttgcaaccagtttcaaggactattttaagaatcgtgctaattgtttctctgcagacgacatttcctcgtcgtcctgccatcgcattgttaatgataatgctgaaatctttttttcaaacgcacttgtgtatcgtcgcattgtcaaaagcttaagtaatgacgatatcaataagatctcaggagacatgaaggactccctgaaagaaatgtcattggaagaaatttactcttatgaaaagtatggagaatttattacgcaggagggtatcagcttctataacgacatttgtggtaaagtgaacagctttatgaatctttattgtcaaaagaataaagagaacaaaaatctgtacaagctgcagaaattgcataaacaaattctgtgcattgcagatacttcgtatgaggttccttacaaattcgagtcggatgaggaggtgtatcaaagcgtaaacggatttttggataacattagtagtaagcatattgtggaacgccttcgcaagattggtgacaactataacggatacaacttagacaagatctatattgtctcgaagttttacgaaagtgtttcccaaaagacttatcgcgactgggagacaatcaacactgcgctggaaattcactataacaatatcttgccggggaacggaaaaagtaaggcagataaggtgaagaaagcagtcaaaaatgatctgcaaaaaagcattactgaaattaacgaacttgtgtcaaattacaaattgtgttcggatgacaatattaaagcggaaacgtatatccacgagatctcgcacattcttaataatttcgaggcgcaggaattaaagtataatcctgagatccatttggtggaatcagaacttaaagctagtgaactgaaaaatgtcctggacgttattatgaatgcatttcactggtgttctgtctttatgacagaagaacttgtcgacaaagacaacaacttttatgcggaattagaagagatttacgacgaaatttatcccgttatttcgttatataatttagttcgtaattacgtgactcagaaaccctacagcacaaaaaagattaaattaaactttgggattccgactcttgctgatggatggagcaagtccaaggagtactctaataacgccattatcttgatgcgtgacaacctgtactacctgggcatttttaacgctaaaaacaaacccgacaaaaagatcattgaagggaacacctcggaaaataagggggactataaaaaaatgatctacaatctgttgccaggcccaaataagatgatcccaaaggtttttttatcttccaaaactggcgtagaaacttacaagccgagcgcatacatccttgaaggatataaacaaaacaaacatatcaaaagttcaaaggacttcgatattacgttctgccatgatttaatcgattatttcaagaattgcatcgcgattcacccagagtggaaaaactttgggtttgatttttcagacaccagcacttacgaggatattagtggattctatcgtgaggttgaactgcagggctataaaattgactggacctatatttctgaaaaagatattgatctgcttcaggagaaaggccaattgtacttatttcaaatctataacaaggatttctccaagaagtccacgggtaatgacaacttacacacaatgtatctgaagaatctgtttagtgaggagaacttgaaggacattgtgctgaagcttaatggcgaggccgaaatcttttttcgtaagtcctccattaaaaaccctattatccataagaaagggagtattcttgtcaaccgcacgtatgaggccgaagaaaaggaccaattcggaaacatccaaattgtccgtaaaaatattcctgagaacatttaccaggagctttacaagtatttcaacgacaagagtgataaagaactttcagatgaggcggcgaaactgaagaatgtagtggggcaccacgaagctgccacgaatattgtaaaggattaccgttacacctacgacaagtactttttgcatatgcccatcacaattaattttaaggccaataaaactggttttatcaacgatcgtatcttacagtacattgctaaggaaaaagatctgcacgttatcggtatcgatcgcggggaacgcaatctgatttatgttagtgtgattgacacgtgcggaaatattgttgagcagaagagctttaatatcgtaaatggatatgactatcaaattaaactgaagcaacaggaaggggcccgccagattgcccgcaaggagtggaaagaaattggaaagatcaaggagattaaagaagggtacctttcccttgttatccacgaaatctcgaaaatggtgatcaagtacaatgccattattgctatggaggatctgtcatatgggtttaagaaaggccgctttaaggtggaacgtcaggtttaccagaagtttgagaccatgcttatcaataagctgaattatcttgtcttcaaagacatctcaatcacagagaacggcgggctgttaaaaggatatcagctgacctatatccccgacaaactgaaaaatgtcgggcaccaatgcggctgtattttctacgtgcccgctgcatacacatctaaaattgacccaacgactggattcgtaaatatttttaagtttaaggatcttacggtagatgcaaagcgcgaatttatcaagaaatttgatagtatccgttacgacagcgagaaaaacttattttgttttacgttcgattataacaacttcatcacgcaaaataccgtcatgtcaaaatcttcctggtcagtctatacgtatggcgtccgtatcaagcgccgcttcgtcaacgggcgtttttcaaacgagtcagataccatcgatatcaccaaagatatggaaaaaacattggagatgacggacatcaattggcgcgatggtcatgacttacgccaggacattattgactacgaaatcgtacaacatatttttgagattttccgtctgaccgtgcaaatgcgcaactcattatccgaacttgaggatcgtgattacgaccgcttgatcagtcctgttctgaacgagaataatattttttacgacagtgccaaggcgggagacgcactgcccaaggacgctgacgctaacggagcttattgtattgcgttgaagggactttacgaaatcaagcaaatcactgaaaactggaaggaggatggtaaattctcacgcgacaagttgaaaatttcgaacaaggactggttcgatttcatccaaaacaagcgttatttaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 47 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaacaacgggactaataacttccagaacttcatcggtatttcatcattacaaaaaacgcttcgtaacgccttgatcccaacagaaacgacccaacaatttattgtaaaaaacggcatcatcaaagaagacgaactgcgtggcgaaaatcgccaaattttgaaggacattatggatgactattatcgtgggtttatctcggagacattatcctccatcgacgacattgattggacgagtctttttgagaaaatggagatccagcttaaaaatggtgataacaaggatacattgatcaaggagcaaaccgagtaccgcaaggccatccataagaagttcgcaaatgacgaccgcttcaaaaatatgtttagtgccaaattgatctcggatatccttcctgagttcgtaattcacaacaataattatagcgcatccgaaaaggaggaaaagactcaagtcattaagcttttcagtcgctttgctacctcgtttaaggactatttcaagaaccgcgcgaactgcttctcagcggatgacatttcttcctcgtcgtgtcaccgcatcgtgaatgataatgcggagatcttctttagtaatgccttggtataccgccgcattgttaaatccctgtctaacgacgatatcaataagatctcaggagatatgaaggatagccttaaagaaatgtctctggaagaaatttactcctatgaaaagtacggtgagtttatcacccaagaggggattagcttttataacgatatctgcgggaaggtgaattcgtttatgaacctttattgtcaaaagaataaggagaataagaacttatataagcttcagaaactgcataaacaaatcttatgcattgccgatactagctatgaagttccgtataaattcgagagcgatgaagaagtttatcagagcgtcaatgggttcttggataacatttcatcaaaacacatcgtggaacgtctgcgtaagattggggataactacaacggatataatcttgacaaaatttatattgtatctaaattctatgagtcggtgagtcaaaagacctaccgtgattgggaaacaatcaataccgcgttagaaatccactataacaacattctgccagggaatggtaaaagtaaagcggacaaagtcaagaaggctgtgaagaacgatctgcaaaagagtattacagagattaacgaattagtctccaattataagttatgctcggacgataacattaaggcggagacgtatattcatgagatttcgcatattcttaacaacttcgaggcacaagagcttaagtataacccagagattcaccttgtcgaatcggagctgaaggcatcggaattaaaaaatgtcttagatgtaatcatgaacgcgttccattggtgcagtgttttcatgactgaggagttagttgacaaggacaataacttctacgcagaattagaagagatctatgatgagatttatccagtgatttcgctgtataatctggtacgtaattacgtcactcaaaagccctactcaacaaaaaaaattaagctgaacttcggaattccgactctggccgacgggtggtccaagtcaaaggagtattctaataatgctatcatcctgatgcgcgataacttatactatttgggaattttcaatgccaaaaataaaccagataaaaagattatcgaaggtaatacaagcgagaataagggtgactataagaaaatgatttacaatcttcttccaggccctaacaagatgattcccaaagtttttttgtccagtaaaacaggggtcgaaacttacaagcccagtgcctatatccttgaagggtacaagcagaataagcacatcaaatcctcgaaagactttgatattacattttgtcatgacttaatcgattattttaagaactgtatcgcaatccatccagaatggaagaacttcgggtttgatttctctgatacttccacgtatgaggatatttccgggttctaccgcgaagtagagcttcagggctataaaattgactggacatatatttcagaaaaagacatcgatctgttacaagaaaaaggacagttgtatctgtttcaaatctataataaggatttctccaaaaagtcaactggaaatgataacttacatacaatgtatctgaaaaatctttttagtgaagagaatttgaaggatatcgtgctgaagttaaatggcgaagcagagatcttcttccgcaagtcctcgatcaagaatcctatcatccacaagaaaggtagtattctggttaaccgcacgtacgaggccgaggaaaaagaccagttcggtaatatccagattgtacgtaagaatattcctgaaaatatttaccaggaattatacaagtattttaacgacaaatcggataaggagctttcagatgaggccgcaaagttgaagaacgtcgtaggacaccatgaggccgctacgaatatcgtcaaggactaccgctatacgtatgacaagtacttcctgcacatgcctattactatcaatttcaaagctaataaaacaggattcatcaatgatcgtatccttcagtacattgccaaagaaaaagatctgcacgtaatcggaatcgaccgtggcgaacgtaatctgatttacgtatcagttatcgacacatgtggtaacatcgtggagcagaaatcttttaacattgttaacggctatgattatcagattaagcttaaacagcaggagggggcacgccaaatcgctcgtaaagaatggaaggagattggaaagattaaagagattaaagaggggtacctttcgctggttattcacgaaatttccaagatggtgattaagtacaatgcaatcatcgcgatggaagatcttagttacggattcaaaaagggacgcttcaaagttgagcgtcaggtctaccagaaatttgaaacgatgctgattaacaaattgaattacttggtattcaaagatatctcaattactgaaaatggtggcttattaaagggttaccagcttacctatatcccggataagctgaagaacgtgggccatcaatgcggctgcatcttttacgtccctgccgcatatacctctaaaattgaccccaccaccggattcgtaaatatttttaaattcaaggacctgacggtggacgccaagcgcgaattcatcaaaaaattcgactcaatccgctatgattccgaaaaaaatcttttctgctttacgttcgattataataacttcattacccaaaacacggtgatgtcaaaatcgtcctggagcgtgtatacttatggagtgcgtatcaagcgccgctttgttaatgggcgcttcagtaacgaaagcgataccatcgacattaccaaagacatggagaagacgcttgaaatgacggatatcaattggcgtgacggacacgatcttcgtcaggatatcatcgactacgagattgtgcaacatatctttgagattttccgtttaactgttcaaatgcgtaactccttgtccgaattggaagaccgtgattacgaccgcttgatttcaccagtgcttaacgagaataacatcttctacgactccgccaaagcaggcgatgccctgccaaaggacgctgatgcaaatggtgcatactgtatcgcgttgaagggcttatacgagattaagcaaatcaccgaaaattggaaagaggatggaaagttcagtcgcgataagctgaagatctctaataaagattggtttgactttatccagaacaaacgttatttaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 48 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaacaacggtaccaataatttccaaaatttcatcggaatctcatccttgcaaaaaaccttgcgcaatgctttgatccccaccgaaaccacgcagcagttcatcgtgaaaaacggcattatcaaagaggatgagttgcgcggggaaaaccgtcaaattcttaaggatatcatggacgattactaccgtgggtttatcagtgagaccctgtcaagcattgacgacattgactggaccagcttatttgagaagatggagattcaattaaagaacggggacaataaggacacgcttatcaaagagcagacagaataccgtaaagcgattcataagaaatttgcaaatgacgatcgcttcaagaacatgttttcagcaaaattaatcagcgacatccttcccgaatttgtgattcataataacaactattcggctagcgaaaaagaggagaaaactcaggttattaagcttttctcgcgttttgccacttcgttcaaagactattttaagaatcgcgcaaactgcttttcggctgatgatatttccagttctagctgccatcgtatcgttaacgataatgctgagattttcttctctaatgccctggtgtatcgtcgtatcgttaaatctttgagcaacgacgatattaataagatttcaggcgacatgaaggattctttaaaggagatgtctttagaagagatttattcctatgagaaatatggcgagtttatcacccaagaaggaatttcgttctacaacgacatctgtggcaaagtgaacagcttcatgaatttatactgccaaaagaataaggagaataaaaatttatataaactgcagaaactgcataagcaaattctttgcattgcagacacctcttatgaagttccttataagtttgaatcggacgaggaggtatatcagagtgtgaacgggttcctggacaatatttcatccaagcatattgttgaacgtttacgcaaaattggagacaattacaatgggtataaccttgacaaaatttacatcgtgtcgaagttttacgaatcggtaagccagaagacctatcgtgactgggaaactatcaataccgccttagaaattcattacaacaatattcttcctggtaacggcaaaagcaaagccgataaggtaaagaaggctgtcaagaacgacctgcaaaagtctatcacagagatcaacgagttagtctctaactacaaattatgttccgacgacaatattaaagccgaaacctacatccatgagatctcacacattcttaacaattttgaggcccaggagctgaaatataacccagaaattcaccttgtagagagcgaattaaaagcctccgagctgaagaacgttttggatgtaatcatgaacgcatttcattggtgcagcgtatttatgacagaggagttggtcgacaaggacaataacttttacgccgagcttgaagaaatctacgatgaaatttacccggtaattagtttatataatttagttcgcaactacgtaactcagaaaccctacagtaccaagaagattaaattgaactttgggatcccgacacttgctgacggttggagtaaatcaaaagaatactccaataatgcaattatcctgatgcgcgacaatctttactacttggggatctttaacgcaaagaacaaaccagataagaaaatcatcgagggcaacaccagcgagaataaaggcgattacaagaaaatgatctataatcttttgccgggaccgaacaaaatgatcccaaaggttttcctgtcgtcgaaaacgggagtcgagacatataaaccatctgcgtacatcttggaaggttacaaacagaataagcatattaagtctagtaaagacttcgacatcaccttttgtcatgacctgattgattatttcaagaactgtattgctatccatccagaatggaaaaacttcggatttgacttctccgatactagcacctacgaagacatttcgggtttttatcgcgaagtagagcttcaagggtacaaaattgattggacatatattagcgagaaagacattgatttgcttcaagagaagggacagttatatttattccagatctacaacaaagacttctcgaagaaatccaccggtaatgataatcttcacactatgtacctgaagaatttattttcagaggaaaatctgaaggacattgtacttaaacttaatggagaagccgaaatcttcttccgcaagagttccattaaaaatccgattattcataaaaagggaagtatccttgtgaaccgcacgtatgaggccgaagagaaggatcagtttgggaatattcaaattgtccgcaaaaacatccccgagaacatctaccaggaactgtataaatactttaatgataaatctgataaagagttatcagacgaggctgccaaactgaaaaacgtagtcggtcatcatgaggcagcgaccaatattgtaaaggactaccgttacacctacgacaagtatttccttcacatgccgatcacgattaattttaaggctaacaagaccggctttatcaatgaccgcatcttgcagtacatcgcgaaagagaaagatttacacgtcatcggaattgatcgtggagagcgtaatcttatctacgtcagcgtcatcgacacctgtggaaacattgtggaacaaaaaagttttaatatcgtaaacggctacgactatcaaattaaacttaaacagcaagagggagctcgccagatcgctcgcaaagagtggaaagagattgggaaaattaaagaaattaaagagggttacctgtcgctggtaattcacgaaatctcgaaaatggtcatcaaatataatgcaattatcgctatggaggatctgtcctacgggttcaagaagggacgttttaaagtagagcgccaggtgtatcaaaaattcgaaaccatgttgatcaataagcttaactatttggtcttcaaagatatttcgattacggagaacggaggtttgttgaaaggatatcagctgacgtatatcccagacaagttgaaaaacgtggggcatcaatgtggatgtattttctatgtgcccgcggcctacacgagtaagatcgatcctaccactggtttcgtcaacattttcaaatttaaagatcttaccgtggatgcgaagcgcgaatttattaagaaatttgatagcattcgctatgattccgaaaagaacctgttctgttttacgttcgactataacaatttcattacccaaaacacggtgatgagcaaatcctcttggtcagtttatacatacggtgtacgtatcaaacgccgtttcgttaacggacgcttttccaatgagtctgatacaatcgatatcacgaaagatatggaaaaaacattagagatgactgatatcaactggcgtgacgggcacgacctgcgtcaagacattattgactacgagattgtgcagcatatcttcgaaatctttcgcttaactgtgcaaatgcgtaactcgttatccgagttagaagaccgtgactacgatcgcctgatttcacccgtcttgaacgaaaataacatcttctacgattccgcgaaggctggggacgcattgcccaaggacgcagacgcgaatggagcgtactgtattgcgcttaaaggattatatgaaatcaagcagatcaccgaaaattggaaggaggacgggaagttctcacgcgacaaactgaagatttcaaataaggactggttcgatttcattcagaataagcgttacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 49 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaataatggtacgaacaactttcagaacttcatcggcatctccagccttcaaaagactttacgcaacgcattgattcccacggagactacgcaacagtttatcgtaaaaaatggtattatcaaagaagatgaattacgcggggagaatcgccagattcttaaggacattatggacgattattaccgtggattcatcagtgagacactgagctccattgatgacatcgactggacgtcattgtttgaaaagatggaaatccagttgaaaaatggcgataacaaagatacattgattaaagagcagacagagtaccgcaaagcaattcacaagaaattcgccaatgatgatcgttttaagaacatgtttagtgccaagcttatttcggatatcttacccgaattcgtgattcacaacaacaattattcggcaagtgagaaagaggaaaagacccaggttatcaaattgttttcgcgcttcgccacttcgttcaaagattatttcaagaaccgtgcaaactgtttctccgctgacgacatcagttccagctcatgccaccgtattgtaaatgacaatgcggagatctttttcagtaatgccttagtatatcgtcgcattgtaaagagcttatctaatgatgacattaacaagatctcgggtgatatgaaggactcacttaaggagatgagtctggaagagatctactcctacgaaaaatacggggaattcatcacccaggagggaatttcattctacaacgatatctgcggcaaagttaactcctttatgaatctgtactgtcaaaagaacaaggagaataaaaacctgtataaattgcagaaacttcataaacaaattttgtgtatcgcagacacgagttatgaagtaccttataaattcgaatccgacgaagaggtatatcagtccgtaaatgggttcctggacaatatcagtagtaagcacattgtggaacgcttacgcaaaattggagacaattacaacgggtataacctggacaaaatctacatcgtatccaaattttatgaaagcgtgtctcaaaaaacttatcgtgattgggaaacaatcaacacggctcttgagatccattacaataacatcttgccgggtaacggcaaatcgaaggcagacaaagttaaaaaagcagttaagaacgacttacagaaaagcattacggagattaacgagttagtaagtaattacaaattatgctccgacgataatatcaaagctgaaacctacatccatgaaattagccacattttgaacaatttcgaagcgcaggagctgaaatataaccctgaaatccatctggtagagtctgagttgaaggcgtcagaactgaaaaacgttcttgacgtcatcatgaatgcctttcactggtgtagtgtttttatgactgaggagcttgtagataaggacaacaacttctatgctgaacttgaagagatctacgatgaaatctaccccgtaatcagtctgtataatttagttcgtaactacgtcacgcagaaaccctattcgactaagaaaattaagctgaactttgggatccctactttggcagacgggtggagcaagagtaaagaatacagtaataatgcaattatcttgatgcgcgataacttatattacttaggtattttcaatgctaagaacaaacctgataagaagattatcgaaggaaatacgagtgagaataagggagactacaaaaagatgatttacaacttgctgccagggcctaataagatgattccaaaagtttttctgtcgagcaagacaggggttgaaacttataagccatccgcttatatccttgaggggtacaagcagaataagcatatcaagtcctccaaagattttgatattacattttgccacgacttaattgattacttcaagaactgcatcgcaatccatcccgaatggaagaatttcggcttcgatttctcagatacgtccacgtatgaggatatctcaggcttttaccgcgaagttgagctgcaaggttataaaattgattggacatacatctccgaaaaagacattgatcttttacaggaaaagggccaattatacttatttcaaatctataacaaagattttagcaagaagtccacaggtaatgataacctgcatacgatgtatttgaaaaatcttttcagtgaagagaatttgaaggatatcgtcctgaagctgaacggtgaggctgagatcttcttccgcaaatcgtctatcaaaaaccccatcattcacaaaaagggaagtatcttagtaaaccgcacttatgaagcggaggaaaaggatcagttcgggaacatccagatcgtgcgcaagaacattccagaaaacatctatcaggaactttacaaatatttcaatgacaagtctgataaagaattatcagacgaggcggcgaaacttaaaaatgttgttggacaccacgaagcagcgacgaatattgtaaaggattatcgctacacatacgataaatactttttgcacatgccaatcaccattaactttaaggcgaacaagacaggtttcattaacgaccgtattctgcaatatatcgcaaaggaaaaagacctgcacgttattgggatcgatcgtggcgaacgcaatttgatctacgtaagcgttatcgacacttgcggaaatatcgttgaacaaaaaagctttaatatcgtcaatggatacgattaccaaatcaagctgaaacaacaagaaggggcacgtcagatcgctcgtaaagaatggaaagagattggtaagatcaaagagattaaagaagggtatctttctttagtaattcacgagatttcgaaaatggttattaaatacaatgcgattattgctatggaagacttaagctacggctttaagaaaggtcgcttcaaagtggagcgccaagtgtatcagaagtttgaaacgatgttgattaacaaattaaattacctggtctttaaggacatcagtatcacagaaaatggggggttgcttaaagggtaccagcttacatacatccctgataaactgaaaaatgtcggtcatcagtgcggatgtatcttctatgtaccagcagcctataccagtaagattgaccctactactggctttgtgaatatttttaaattcaaggatttaaccgtggacgccaagcgtgaatttattaaaaaatttgattcgattcgctacgacagtgagaaaaaccttttctgctttacctttgactacaacaattttattacccagaacaccgtaatgtcaaagagttcgtggtctgtatatacctacggtgttcgcatcaagcgccgcttcgtaaacgggcgtttcagtaacgaatctgacaccatcgacatcactaaagatatggagaagacattggaaatgacggacattaattggcgtgatggccatgacttacgtcaggacattattgattacgaaattgtgcagcatatcttcgagattttccgtttgacagttcagatgcgcaactcactgagtgagttagaagatcgcgattacgaccgtctgatctcaccggtccttaatgaaaacaacattttctacgactcagcaaaggcgggtgatgccctgccaaaggatgcggacgctaatggcgcctactgcatcgccctgaaaggattgtatgaaattaagcagattacagaaaattggaaggaagatggtaaatttagccgtgataaattaaaaatctcgaacaaggattggttcgattttattcagaacaaacgttatttgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 50 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaacaatggaacaaataattttcaaaattttatcggcatctcaagtcttcaaaaaacccttcgcaatgccctgattccaactgaaacaacccagcaatttatcgtcaagaacggcatcattaaggaagacgagttacgcggggagaaccgtcaaatcctgaaagatatcatggatgactactatcgtgggttcatttcggaaaccttgtcttcaatcgacgacattgactggacgagtcttttcgagaaaatggaaattcagcttaaaaatggagacaacaaggatactctgattaaggaacagacagaatatcgcaaagctatccacaaaaagttcgctaatgatgatcgtttcaaaaatatgttttctgctaaattgatttccgatatcttgcctgaatttgtaatccacaacaacaattattctgcttccgagaaggaagagaagacccaggtcattaaattattcagccgctttgcaaccagctttaaagactactttaagaatcgcgctaactgcttttcggcggatgacatctcatcatcatcatgccaccgcattgtgaacgacaatgcggagatcttcttttcgaatgcgttagtttatcgtcgcattgtcaaaagtcttagcaatgatgacatcaacaagatctcaggagacatgaaagattccttaaaggagatgtctcttgaggaaatctattcgtatgagaaatacggcgagttcattacccaggaaggtattagtttctacaatgatatctgcggcaaagtaaattcttttatgaatctgtattgccaaaaaaacaaagaaaacaagaatctttataagttacaaaagttacataagcaaattctgtgcatcgctgatacatcttatgaggtaccctacaaatttgaaagtgatgaggaggtctatcagagtgtcaacggcttcttagacaacatctcttccaaacatatcgtggaacgcctgcgtaaaatcggagataactacaacggatataacttagataaaatctacatcgtgtccaagttttatgaaagtgtgagccaaaaaacatatcgtgactgggaaaccattaacaccgcattggaaattcactataacaacattttgccaggcaacgggaaaagtaaggcggacaaagttaagaaagcagttaaaaatgacctgcaaaaaagcatcactgaaattaacgaattggtatcgaattacaaattatgtagcgacgataatatcaaagcagaaacttacattcacgagattagtcacattttaaataacttcgaggcccaggaattgaaatacaatcccgaaattcatttggttgaatcagaactgaaagcatcagagttgaaaaatgtgttagatgtcattatgaatgcgtttcattggtgctctgtgttcatgaccgaggaactggttgataaagataacaacttttacgctgaattggaggagatttacgatgagatttacccggtcatttcgctttataacttagtgcgcaattatgtgacgcagaaaccatattccacgaagaaaatcaaacttaattttggcatccctactctggctgatggttggtcgaaatcgaaagagtacagcaacaacgcgatcattcttatgcgtgacaatctttactatttgggcatttttaatgccaagaataagccagataagaaaatcattgaggggaatacttccgagaataagggggattacaaaaagatgatctataacttgctgcccggccccaacaaaatgattcctaaggttttcttgtcaagcaagacgggcgtcgaaacatataagccgtcagcttatattctggaaggctataaacagaataagcacatcaagtcttccaaggactttgacatcactttttgccacgatttgatcgactactttaagaactgtattgcgattcatccggaatggaagaacttcggtttcgacttttccgatacctcaacatacgaggatatcagcggcttctaccgtgaagtcgagcttcaaggctacaagatcgattggacatatatttcagagaaggacattgatttgttacaagagaaaggtcaactttacttatttcagatctataacaaagacttttcgaagaaatcgacaggaaacgataacttacacactatgtatttaaaaaatctgttttcggaggaaaacctgaaagatattgtgctgaaacttaacggcgaggcagagatctttttccgtaaaagctcaatcaagaatcctatcatccataaaaaaggtagtattcttgtcaaccgcacatatgaagcggaggagaaggaccaattcggaaacatccaaattgtccgtaagaatattccggagaacatttaccaagagttgtataaatactttaacgataagtcagataaggaacttagcgatgaggcggcgaagcttaaaaacgtagttgggcatcatgaagctgctaccaacattgtaaaagattaccgttacacctatgacaagtatttcttgcacatgcccattacgatcaatttcaaagcaaataagacaggctttatcaatgatcgcatcctgcagtacattgctaaagagaaggatttgcatgttatcggtattgatcgcggagagcgcaatttgatctacgtctccgtaatcgacacttgcggtaacattgttgagcagaagtcgttcaacatcgttaatggttatgattaccaaatcaagctgaagcagcaagagggtgcccgccagatcgcgcgtaaggaatggaaagaaatcgggaaaattaaagagatcaaagaaggctatttgtctctggtaattcacgaaatcagcaagatggtgatcaagtataacgcgatcattgcgatggaggatctttcttatggcttcaagaaagggcgctttaaagtcgaacgccaggtctaccagaaatttgagacaatgcttatcaacaagcttaactatcttgtatttaaggatatttccatcactgagaacggaggacttttaaaggggtaccaactgacgtacattcctgataagctgaagaacgttggtcatcaatgcggatgcatcttctatgtgccagcggcttacacctccaaaatcgatcccactacaggctttgtcaatatcttcaaattcaaggatttgaccgttgacgcgaagcgcgagtttatcaagaagtttgatagcattcgctacgacagcgaaaaaaatttattttgttttactttcgactacaataactttattactcagaacactgtcatgtcaaagagttcgtggagtgtctacacgtacggagtacgtattaagcgccgtttcgtcaacggacgcttctcaaacgaaagcgacacgatcgacatcaccaaagacatggaaaaaactcttgagatgacggatatcaattggcgcgacggccatgacctgcgtcaggatatcattgattacgagatcgttcagcacatcttcgaaatcttccgccttaccgtccagatgcgcaacagtttaagcgagcttgaagaccgcgactacgatcgtttgattagccccgttctgaacgagaataatattttctacgacagcgcaaaggccggtgatgctttgccaaaggacgcagacgcgaatggagcctactgcatcgccctgaagggcttatatgagattaagcaaattaccgaaaattggaaggaagatggtaagttctcccgtgataagcttaaaattagcaataaggattggttcgacttcatccagaacaaacgttacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 51 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaacaacggaacaaacaatttccaaaacttcatcggtatctcttcgttgcagaagactctgcgtaatgctttgatcccgacggagacaacccaacaatttatcgtcaaaaacggtattattaaggaggacgagttacgtggagaaaatcgtcaaatccttaaggacatcatggacgattattatcgcgggtttatttctgaaaccctgagcagtatcgatgatatcgactggacctcactttttgagaaaatggagatccagttgaagaacggtgataacaaagacactctgatcaaagagcaaactgaataccgcaaggcaattcacaaaaagttcgccaacgacgaccgtttcaagaatatgttctcagctaagttaatcagcgacattttgccagagttcgttatccacaacaataattatagtgcttcagagaaggaggaaaaaacccaagtgattaaacttttttcgcgctttgcaacctcattcaaggactacttcaagaatcgcgcgaattgcttcagtgcggacgacatttcttcttcaagttgccatcgtatcgttaacgataacgcggaaattttcttctctaatgctttggtgtatcgccgcattgtaaaatcgcttagtaacgatgacattaataagatctcaggtgatatgaaagattcattgaaggaaatgagcttggaagagatttacagttacgaaaaatatggagaatttattactcaggaaggcatctcattctataacgatatctgcgggaaggtaaattcgtttatgaacttatattgccagaaaaataaagagaataaaaatttgtataagcttcagaagttgcacaaacagatcctgtgcattgcagacacctcgtatgaggttccgtataaatttgagtccgatgaagaagtgtatcagtctgtgaatggtttcttagataatatctcttccaagcatattgtcgaacgcctgcgcaaaattggtgataactataacggatacaatctggataaaatttacatcgtttctaaattttacgagtcagtctcgcagaagacctaccgcgactgggaaacaattaacacggcattggagattcactacaataatatcttgcctggtaacggtaagtctaaggcagataaggtaaaaaaagctgtgaaaaacgaccttcagaaaagcatcacggagattaatgagctggtgagtaattacaaattatgttcagacgataatattaaagctgaaacgtatatccatgaaatctcgcatatcttgaacaacttcgaggcccaagaacttaaatataaccccgaaatccatttagtcgagtctgaattgaaagcgtcggaattaaaaaacgtcttagacgtcattatgaacgcgtttcactggtgttcagttttcatgaccgaagagctggtcgacaaagacaacaacttctatgcggaattggaggaaatctatgatgaaatctaccctgttatttcactgtataaccttgtgcgcaactatgtcactcagaagccgtattcgaccaaaaaaattaaattgaatttcggtatccctactcttgcagacggatggagtaaaagcaaggaatacagtaataacgccattattcttatgcgcgacaatttatactacctgggcatctttaacgcaaagaataagccggataagaagattattgagggtaacaccagtgagaacaagggcgactataagaagatgatctataacttattgccaggtccaaataaaatgatcccaaaagtattcttatcatcaaagacgggagttgaaacctataagcctagtgcctatattcttgagggatataaacagaacaagcacattaagtcgtctaaggattttgacattacgttctgccatgacttaatcgactattttaaaaactgtattgcgattcaccccgaatggaagaattttggattcgatttttcggatacctcgacctatgaagatatttcgggattttatcgtgaagtggagttgcaaggctataaaatcgattggacctatatctcagaaaaagacattgatttattacaggaaaagggacaactgtaccttttccaaatttataacaaggacttttctaaaaagtccacaggaaatgataaccttcacaccatgtacctgaagaaccttttctcagaggaaaacctgaaggacattgtccttaagttaaatggagaagcggagatctttttccgtaaatctagtatcaagaatccgattatccataaaaaaggttcgattttggtaaatcgcacctatgaagcggaagagaaagatcaatttggtaacatccagatcgtgcgcaagaatatcccggagaacatttaccaagagctgtataagtacttcaatgataagtctgataaggaactgtcagatgaagctgcgaaattgaagaacgtggttgggcatcatgaagccgctaccaatatcgtcaaggattaccgttatacctatgacaaatatttcttacacatgccgattacgatcaattttaaggcaaacaagacaggattcatcaacgaccgtatcttgcagtatattgccaaagagaaggatctgcatgtgatcggtattgaccgcggggagcgcaatttaatctatgtatcggtgatcgatacttgtggtaacatcgtagaacaaaagagctttaacatcgtgaatggttacgactatcagatcaagctgaaacaacaggaaggagcccgccagatcgctcgcaaggaatggaaagaaatcgggaaaattaaggaaatcaaggaaggctacctttcattggtcattcacgaaatttcgaaaatggtaattaagtacaacgcgatcatcgccatggaggacctttcgtacggatttaagaagggtcgtttcaaagttgagcgccaggtataccaaaaattcgagactatgcttatcaacaaacttaactacttggtctttaaggacatttctattaccgaaaacggcggcttacttaaaggctatcaattgacatatattcccgacaaactgaagaatgttggacatcaatgcgggtgtattttctatgtgccggcagcttacactagtaagatcgaccctacaaccgggttcgtaaacatttttaaattcaaagacttaacagtcgatgcgaagcgtgaatttattaagaagtttgatagtatccgctatgacagtgaaaagaacttgttttgctttacgttcgactacaataactttattacacagaacacggtcatgtctaaatcatcatggtcggtttacacatatggggtgcgcatcaagcgtcgctttgtaaatggccgttttagtaatgagagcgacacaatcgacatcacaaaggatatggagaaaactcttgagatgacagacatcaattggcgtgacggtcatgacttacgccaagatatcatcgactacgaaatcgtacagcatatttttgagatttttcgtcttactgtgcaaatgcgtaattctttatccgaactggaagatcgtgattacgaccgcttgattagtcccgtcttaaatgagaacaatattttctatgattctgcgaaagccggagatgcactgcccaaagacgctgatgccaatggcgcgtattgcattgcattaaaaggattatatgagattaaacagattaccgaaaattggaaagaggacggtaaattctcacgcgataaattgaagatttctaacaaggactggttcgactttatccaaaataaacgttatcttaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 52 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaataacggtaccaacaactttcagaatttcattggcattagctcgcttcaaaaaactttacgcaatgctcttattccgactgagacgacacaacagtttatcgttaagaatggcatcatcaaagaagatgaattacgcggagaaaaccgccagatcctgaaagacattatggacgattattaccgtgggttcatctccgagacgttgtcatcgatcgatgacatcgactggacgtcactttttgaaaaaatggagatccagttaaagaacggtgacaataaggatacattgatcaaagaacagaccgagtaccgtaaagcgattcataaaaagtttgcgaacgatgatcgcttcaagaatatgttttctgcgaaattaatttccgacattttacctgaatttgttattcataataacaactactcggcgtctgagaaagaggagaaaacccaagtgattaaacttttttcacgtttcgcaacgtcgttcaaagactattttaaaaatcgtgctaattgctttagcgcggatgacatcagctctagttcatgtcatcgcattgtcaacgataatgctgagatctttttcagtaatgcgttagtgtaccgtcgtattgtgaagtccttatctaatgatgatatcaataagatcagcggggatatgaaggactcacttaaggagatgagcttggaggaaatctattcctatgagaagtatggtgagtttattacgcaagaaggaattagcttttacaacgatatctgtggaaaggtgaattcgtttatgaatttgtattgccagaaaaataaggagaacaagaacctttataaattgcaaaagttacacaagcaaatcctgtgcattgcagatacttcctacgaggtgccttacaagtttgaatccgacgaagaggtctaccaatctgtaaacggtttcttagataatattagttccaagcatattgtggagcgccttcgtaaaattggcgataattacaacggttacaatttagacaaaatttacattgtcagtaaattctacgagtccgtatctcaaaagacgtatcgtgattgggagactatcaatacggccctggagatccactacaacaatatcttgcccggtaatggtaagtcgaaggccgataaagttaagaaagcggtgaaaaatgacttacagaagtcaatcaccgaaattaacgaattggtgtccaattataaattgtgttcagatgataatatcaaagccgagacctacattcatgagatttcccatatcttaaataatttcgaggcgcaagagcttaagtataacccagaaatccacctggtagaatctgagttgaaggcgtcagagttaaaaaatgttttagatgtcattatgaacgcgtttcactggtgctccgtatttatgacggaggaattagtagataaagacaacaatttctatgccgaacttgaggaaatctatgatgagatctatcccgtcattagcctgtataacttggtccgcaactatgttacccaaaaaccgtacagtaccaagaagattaagctgaatttcggcattcctacactggctgatggttggagtaaatcgaaggaatattcgaataacgcgattatcttgatgcgcgacaacttatactatttggggatctttaacgccaaaaacaaaccggataagaagattattgagggaaacacatcagagaacaaaggcgactacaaaaaaatgatttacaacttgttaccggggcctaacaaaatgatcccgaaggtgttcttatccagtaaaacaggcgttgagacctacaaaccttccgcatacatcctggaagggtataagcagaacaagcacattaagtccagcaaggatttcgatattaccttctgtcatgatttaattgactatttcaagaactgtattgcaatccaccccgagtggaagaacttcggattcgacttctcagatacgagcacatatgaggacatctcggggttctatcgtgaagtagaactgcagggatataaaattgattggacatatatttccgaaaaagacatcgaccttttacaagagaagggtcaactttacttgttccaaatttacaataaagacttctcaaaaaaaagcacgggtaacgataatttacacactatgtatttaaagaaccttttctcggaagagaatttaaaggatatcgtattgaagttgaatggagaagcggagatcttcttccgtaagtccagtattaaaaaccctattattcacaagaagggatcgattttagttaaccgcacatacgaggccgaagagaaggaccaatttgggaacattcaaattgtccgcaaaaacatccctgagaacatttatcaagagctttataagtactttaacgataagtccgataaggaattgtcagatgaggcggcaaagttgaagaatgtcgtggggcatcatgaagctgccaccaacattgtgaaggactaccgctacacttacgacaaatacttcctgcacatgcccattacgatcaattttaaggccaataagacaggctttattaacgaccgtattcttcaatatatcgctaaggagaaggaccttcatgtgattgggatcgaccgcggagaacgtaatttaatttatgtgtccgtcatcgatacgtgtggaaatatcgtggaacagaaatcattcaatatcgtgaatggctatgattaccagatcaaattaaaacagcaggagggcgctcgccaaattgcgcgtaaggaatggaaagagatcggaaaaatcaaagaaatcaaagaaggatatttgtcattggtgatccatgagatttcaaaaatggtaattaaatataatgcaattatcgcaatggaagacctgtcctatggttttaagaagggtcgtttcaaggtagaacgccaagtgtatcaaaagttcgagacgatgctgatcaataagctgaattatcttgtgtttaaggacattagcatcacggaaaatggagggctgttgaaaggctatcaactgacgtatatccctgacaagctgaaaaatgttggccatcagtgcgggtgcattttctacgtccccgcggcgtatacaagcaagatcgatcctactacgggattcgtaaatatttttaaattcaaagacttaaccgtggacgccaagcgcgaattcattaagaagtttgatagcattcgctacgattcagaaaaaaatcttttctgttttacgttcgattacaacaattttatcacccagaacacagtgatgagcaagtcatcctggtctgtctatacctacggtgtccgtatcaaacgccgcttcgtcaacggacgcttctctaatgaatctgataccattgacatcaccaaggacatggaaaagacacttgagatgacagatattaactggcgtgacggacatgacctgcgtcaggacatcatcgattatgagattgttcagcatatcttcgagatcttccgcctgacagtacaaatgcgcaattcactgtcagaacttgaagaccgcgactatgaccgcctgatctctccagtattaaatgagaacaatatcttttatgacagtgctaaggccggcgatgcccttccgaaagatgctgatgctaacggagcttattgtattgcattaaagggtctttatgagatcaagcaaattaccgagaattggaaggaggatggcaaattctcgcgcgacaaactgaaaatcagtaacaaggactggttcgattttattcagaataaacgttacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 53 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaataacggaacgaacaacttccagaacttcatcggcatcagttctttacaaaaaaccctgcgtaacgcccttattccgactgagacaacacaacagttcatcgttaaaaacggaattatcaaagaggacgagttgcgcggcgagaatcgccaaattttgaaagatattatggacgactattatcgtggttttatttcagaaacactgagttcgattgacgatatcgattggacgagcctgtttgagaaaatggaaatccagttgaaaaatggcgataataaagacactttaatcaaagaacaaaccgagtatcgtaaagcgatccataaaaagttcgctaatgacgatcgttttaagaatatgttcagtgcgaaactgatttcagacattttgcccgagttcgtgatccataataacaactattccgcctcggaaaaggaagaaaaaacccaggtgattaagctgttcagtcgcttcgcaacatctttcaaggattatttcaagaatcgcgcgaattgcttcagtgcggacgatatttctagttcaagctgccatcgtatcgttaatgataacgcggagattttttttagcaatgctctggtgtaccgccgcattgttaagtcactgtccaacgatgatattaacaagatctcaggagacatgaaagactcgcttaaagagatgagtctggaagagatctattcttatgagaagtatggcgagtttattacccaagaaggaatctcattctacaatgatatttgtggaaaggtgaacagctttatgaatctttactgccaaaaaaacaaggagaataagaatctttacaaacttcagaagttacataaacagattttgtgtattgcggatacgtcttatgaagtcccctacaaatttgaatcggatgaagaggtataccaaagtgtgaacggattcttggacaatatttcttctaaacatattgttgaacgcttacgtaagatcggggataactacaatggctacaatcttgacaaaatctacattgttagcaaattctacgagagtgtcagccaaaagacgtaccgcgattgggaaacaattaatactgcgcttgagattcactataataacattttaccaggcaacggcaagtccaaggcggataaagttaaaaaagctgttaaaaacgatttgcaaaaatctatcacagaaattaacgagttagttagtaactacaaactgtgctccgatgacaacattaaggctgagacgtatatccatgagatctctcacatcttaaacaattttgaagctcaagaacttaagtacaatccggaaatccacctggtggaatccgagctgaaggctagcgaactgaagaacgtattggacgtgatcatgaacgcgttccactggtgttctgtctttatgacggaagagcttgtcgacaaagataataacttttacgcggaacttgaggaaatttacgatgagatttacccagttatttcattgtataaccttgtccgtaattacgtgacccaaaagccttatagtacgaaaaaaatcaaattaaattttggaatcccaacactggctgacggttggagcaaatctaaggagtattctaataacgcaatcatcttaatgcgtgacaacctgtattatttgggtatcttcaatgccaaaaataagcctgacaaaaagattatcgaaggaaatacttcggagaataagggggattacaaaaaaatgatttacaatttgctgcccgggccgaacaagatgatccccaaagtgttcttatcctcgaagactggtgtagaaacatacaagccaagcgcatacattctggagggttacaagcaaaacaaacacatcaaatcttcaaaagactttgacattacattttgccatgatcttattgactacttcaaaaactgcattgctattcaccccgagtggaagaactttgggtttgacttcagcgacacgtctacgtatgaggacatctccgggttctaccgtgaagttgagttacaagggtataagattgactggacgtatatttcagagaaagatatcgatcttttgcaggaaaagggccagttatatttattccagatttacaacaaggactttagtaagaagtcaacaggaaatgacaacttgcatacgatgtatttgaaaaatcttttttctgaggaaaatcttaaggacatcgtactgaaattgaatggcgaggctgaaatcttcttccgtaaatcctccattaagaatcccattatccacaaaaaggggtctatcctggtgaatcgtacctacgaggcagaggagaaggatcaattcggaaatattcagattgttcgtaagaacatccccgagaacatttatcaagaattgtataagtactttaatgacaaatctgacaaagagttatccgacgaagctgcgaaactgaaaaacgttgttggtcaccacgaggccgccactaatatcgtaaaagactaccgttatacctatgacaagtactttttgcacatgccgatcactatcaacttcaaggcgaataagacgggcttcattaacgatcgtatcctgcaatacatcgccaaggagaaggaccttcacgtcattgggattgaccgtggtgagcgtaacctgatttatgtaagcgtcattgatacctgcggtaatatcgtcgaacagaaaagtttcaacattgtaaatggatatgactatcagatcaaacttaagcagcaggagggtgcacgccagattgcccgcaaggaatggaaggagattgggaagattaaggaaattaaagaaggttacttatcactggttattcacgagatcagtaaaatggtaatcaaatataacgcgatcattgccatggaggatctgagctatggctttaaaaagggccgtttcaaagtcgagcgccaggtatatcaaaagtttgaaacaatgctgattaacaaattaaactatctggttttcaaagatatttcgatcactgaaaatggcgggctgttgaagggataccaacttacatacatccctgacaaactgaaaaatgtcggtcaccaatgtggatgtatcttttatgtaccagcagcgtatacgagcaaaatcgatccaactacgggttttgtgaacatctttaagttcaaggatttgacagtagatgccaaacgcgagttcattaaaaaatttgattcaattcgctacgattcagagaaaaatcttttttgtttcacgttcgattacaataatttcattacgcagaacacagtaatgtcaaagtcaagctggtcggtctacacgtatggagtccgtattaaacgtcgttttgtaaacggccgtttctcaaatgaatcagatacaattgatattacgaaggatatggagaagacattagagatgactgacattaactggcgcgacggacatgatcttcgtcaggacattattgattatgagattgtacagcatatctttgagatcttccgcctgaccgttcagatgcgcaattcgttgtccgagttagaagaccgcgattacgaccgtttaatcagtcccgtcttaaacgaaaataacatcttctacgattcagccaaggcaggcgatgccttgccaaaggatgctgacgcaaatggcgcatactgtattgcgttgaaaggcctttatgaaatcaagcaaattaccgaaaactggaaagaagacggaaaattctcccgtgataagttgaaaatctctaataaggattggttcgatttcatccaaaataaacgctatttgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 54 - DNA, 4028 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaacaacggaactaataatttccaaaattttataggcatctcttctttacagaagactcttcgtaacgccctaatcccgactgagaccacacaacaattcatagtgaaaaatgggatcattaaagaagacgagctgcgtggggagaacaggcagatcctaaaagacataatggacgattattatagagggttcatctcagagacattatctagcatcgacgacattgactggacctccctgtttgaaaaaatggaaatccagctgaagaatggtgacaataaagacacattaataaaagaacaaacagagtacaggaaagccatccacaagaagttcgcaaacgatgacagattcaaaaatatgttcagtgcgaagctaatatccgacatcttaccagagtttgtaatacacaataacaattacagcgcgagcgaaaaggaagagaaaacgcaagtaattaagctttttagtaggttcgctacctctttcaaagattacttcaaaaatcgtgctaactgcttctcagccgacgacatatcttcaagttcctgtcaccgtatcgtgaatgataacgctgagatattcttctcaaacgcccttgtataccgtaggatcgtaaagtccttatctaacgatgatataaacaagatcagtggagacatgaaagacagccttaaagagatgtctctagaagaaatttactcctatgaaaagtatggggagtttataacacaggaggggatcagcttctacaacgacatctgcggaaaggtgaacagtttcatgaatctttactgccagaagaataaagagaacaaaaatctttataagcttcaaaagttgcacaaacaaatactgtgcattgccgatacatcatatgaggtcccctataagttcgaatctgatgaggaagtttatcaatctgttaacggctttctagacaatatcagctcaaaacacatcgtagaaagactgaggaaaataggtgataattataatggatacaacttggataaaatatatatagtctctaaattttacgagtcagtatcccagaaaacgtatagggattgggagaccatcaacacggcgttagagattcattacaataacatcttaccgggaaacggaaaaagtaaggcggacaaagtaaagaaagccgttaaaaatgacttacaaaagagtataacagaaataaacgaactagtaagcaactacaagctttgttccgatgataatatcaaggccgagacatatatccatgagatctcccacattctaaacaatttcgaagcgcaagaacttaaatataatcccgaaatccacctggtggaaagtgaactaaaggctagtgagttaaagaacgttcttgatgttatcatgaacgccttccattggtgctctgtttttatgaccgaggagttggttgataaagataataatttctacgctgaattagaggagatatacgacgaaatctacccagtgatttcactatacaacttggtcaggaactatgttacacaaaagccgtacagcactaagaaaattaagctaaatttcggtatccccacgttagccgacgggtggagcaagtccaaagaatattccaacaatgcgattattttaatgcgtgacaatctttattaccttggcatcttcaatgccaaaaacaaacctgacaaaaagattatagaaggtaatacgtccgagaacaaaggcgattacaagaagatgatttataacctactgcccggaccaaacaaaatgatccccaaagtttttcttagttctaaaaccggcgtagagacgtataaaccttctgcctatatcttagagggatataagcagaacaaacatatcaaatcttccaaggactttgatattacattctgccacgatttaattgactacttcaaaaattgcatagcgatacatccggagtggaagaactttggcttcgacttcagtgatacatccacctatgaggatatatcaggcttctatcgtgaggtcgaattgcaagggtacaaaatcgattggacgtatatatccgagaaagacatagaccttcttcaagaaaaggggcagttatatttattccaaatatacaacaaggacttcagtaagaagtcaacaggtaatgacaacttacacaccatgtacttgaaaaatttattttctgaagaaaacctaaaggacattgtactaaaactgaacggggaggcagaaattttttttagaaagagcagcataaaaaacccaataattcataagaaaggaagcattttagttaataggacgtacgaggcagaggaaaaggaccagtttggcaatatccagatcgtaaggaaaaatattcctgaaaacatatatcaggaactatataaatactttaacgacaaatccgacaaagaattatccgacgaggctgcaaagctgaagaacgtcgtagggcaccatgaggcagcgactaatattgtgaaagactataggtatacatacgacaaatactttctgcacatgcccatcacgattaacttcaaggcgaacaagacgggattcattaacgaccgtatattacaatatattgctaaggagaaagatctgcatgtaataggtatcgacagaggcgaacgtaatttaatctacgtgtccgtcatcgacacgtgcgggaacatcgtagagcaaaagagttttaatatagtaaatggctatgattaccaaattaagctaaagcagcaagaaggagcaagacagatagctaggaaagaatggaaggagataggaaaaataaaggagatcaaggaggggtatcttagcctagtaattcatgaaatatctaagatggttatcaaatacaacgctatcatagcgatggaagacttatcttatggtttcaagaaaggaaggttcaaagtagagcgtcaagtttatcaaaagttcgaaacgatgttgattaataaactaaactatttggtatttaaagatatatctatcaccgagaatggtggtctactaaagggttaccagcttacatacataccggacaaacttaaaaacgtcggacatcagtgtggatgcattttctacgttccagctgcatataccagcaagatcgacccaacgactgggttcgtaaatatttttaaattcaaggatttgactgtcgacgccaaaagagagttcataaaaaagttcgattcaattaggtacgacagcgaaaagaatttgttctgctttacttttgactataacaatttcattactcagaacactgtaatgtctaagtcctcttggtcagtctatacttatggcgttcgtatcaaacgtagatttgttaacggtagattctcaaatgaaagtgatacaatagatatcacgaaagatatggagaaaacattagaaatgacagacataaactggagagacggacatgacttgagacaggacattattgactacgagatcgtgcagcacatctttgagatctttcgtttgaccgtacaaatgcgtaacagtttatctgagcttgaggacagggactacgatagattgatatcacctgtattaaatgagaataacatcttctatgattccgcaaaagcaggcgacgctctacccaaagacgctgatgcgaacggtgcttattgcatagctttaaagggtttgtatgagatcaaacagataacagaaaattggaaggaagatggtaagttctcccgtgacaagcttaaaatatcaaataaggactggttcgattttatacagaataagcgttattaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 55 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaacaatggaactaataacttccagaatttcattggtatctcctctttacaaaaaactctaagaaacgccctaattccgactgaaactacacagcaattcatcgtcaaaaacgggatcattaaggaggatgagttgaggggtgaaaatcgtcaaattcttaaagacatcatggacgactactacagggggttcatcagcgagacgttatctagtatagacgatatagactggacttcactgttcgagaagatggaaatccaattaaaaaatggggacaataaagatacacttataaaggaacagacagagtatagaaaggcaatacacaaaaagtttgccaacgacgatcgtttcaagaacatgtttagtgctaaattgatttcagatattctgccggaatttgttattcacaacaataattatagcgccagtgagaaagaagaaaaaacgcaggttatcaaactgttcagtcgtttcgctacatcttttaaggattactttaaaaaccgtgcaaattgtttttcagccgacgatattagtagcagctcttgtcaccgtattgttaatgataatgcggagattttcttttcaaacgcattggtctacaggaggatagtcaagtccctttcaaatgacgacattaataagatctcaggtgacatgaaagattccttaaaggaaatgtccctggaagagatctattcctatgaaaagtacggtgagttcattactcaagagggtataagcttttacaatgacatatgtggtaaggttaatagctttatgaacctgtattgccagaagaacaaagaaaataagaatctgtataagttgcaaaagctacacaaacaaattttgtgcattgccgatacatcatacgaggtgccatacaaattcgagagcgatgaggaggtttatcagagcgtgaatggattcctggacaatattagtagtaagcatatcgtggaaaggcttagaaagataggtgacaattacaatggctacaatctggataaaatctacatcgtctcaaaattctatgaaagtgtatcccagaagacgtaccgtgattgggaaactatcaacaccgctctggagatacattacaacaatatacttcccggaaacggcaagtcaaaagccgacaaagtcaaaaaagcggtcaagaacgatttacaaaagtctatcactgaaattaatgaattagttagtaattacaaactgtgtagtgatgataatattaaggcagagacttacatacacgaaatttcacacattttaaacaacttcgaggcacaggaacttaaatataatcctgaaattcacctggttgaaagtgaattgaaagccagcgagctaaagaacgttttggacgtaatcatgaacgcattccactggtgctctgtctttatgacagaggaactagtggataaggacaataatttttatgcggagctggaggaaatatacgatgagatatatcccgtaatatcattatataatctggtaagaaactatgtgactcaaaagccgtatagcaccaagaaaattaaacttaatttcggcatacccactttagcggacggctggtcaaaatccaaagagtatagtaataatgccatcatcctgatgcgtgacaacctgtactatttaggtatatttaacgccaaaaataaacccgacaaaaagattatagagggcaacacctcagagaacaaaggtgattataagaagatgatttacaaccttttacccggtcctaataagatgattcccaaagtctttctatctagcaaaactggtgttgaaacatacaaaccctcagcttatattttagaagggtataagcagaataagcatattaaaagctccaaagatttcgatattaccttttgccatgacttgatagactatttcaaaaattgtattgccattcaccctgaatggaaaaacttcggatttgacttctctgacacatccacctacgaagacatttcaggtttttacagggaagtcgagctacagggttataaaattgattggacatacatcagcgagaaagatattgacctacttcaagaaaaagggcagctatacctgttccagatatacaataaagacttcagtaaaaaaagcaccgggaacgataatcttcacacaatgtacttaaaaaatttatttagtgaagagaatctgaaggatatagtgctgaagttaaacggggaggcagagatattttttagaaaatctagtattaagaatccgatcatccacaagaagggttctatccttgttaataggacttatgaggcagaagaaaaagaccaattcggcaacatacaaattgtccgtaaaaatatccctgagaacatttatcaggaactatacaagtacttcaatgataaaagcgacaaggagctgagcgacgaggctgctaagttaaagaatgtggtgggccaccatgaggcagcaacgaatattgtgaaggactatcgttatacctacgataaatactttcttcatatgccgatcaccattaatttcaaggcaaacaaaactggcttcattaacgatcgtatcttacaatatatcgcaaaagagaaagaccttcacgttatcgggatcgatagaggcgagcgtaacctaatttatgtttctgtgatagacacctgtgggaacatagtcgaacagaaatcatttaatattgttaacggctacgattatcagataaagttgaagcaacaagagggtgcacgtcaaatagcaaggaaagaatggaaagaaataggcaagattaaagaaataaaagaaggttatttatcccttgtaatacacgaaattagcaaaatggtgattaaatataatgcgatcattgccatggaggatctttcttacggcttcaaaaaggggagattcaaagtcgagaggcaggtgtatcagaagtttgagaccatgctaatcaataaactaaattatctagtattcaaagacataagcatcaccgaaaatggcggcttgttgaagggttatcaattgacctacatcccagataaactaaaaaacgtagggcatcaatgcggatgtatattttacgttccagccgcatacacttccaaaatcgatccaactacgggttttgtgaacatcttcaaattcaaagacttgactgtcgatgctaagagggagtttatcaagaaatttgactccattagatacgacagtgagaagaatctgttctgttttacctttgattataacaactttataactcaaaacacagtcatgagtaagtcatcttggtcagtgtatacgtatggtgtgaggattaaaaggaggtttgttaacgggagattttccaatgaaagtgatacaatagatataaccaaggacatggaaaagactcttgaaatgaccgacattaactggagagatggccacgacttacgtcaagatataatcgattacgagatagtgcaacatatctttgagatatttaggcttactgtccaaatgcgtaactcattaagtgagttggaggacagggattacgataggctaataagtcctgttcttaacgaaaacaatatattctacgattcagcaaaggcgggagacgccctgcccaaggacgcggatgctaacggcgcatactgtattgccctgaaaggcttgtacgagataaaacagatcacggagaactggaaagaagatggaaaattcagtcgtgacaagttaaaaattagtaacaaagactggttcgactttattcagaacaagagatatctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 56 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaacaacggaaccaataactttcaaaactttataggcatctccagtctacagaagacactacgtaacgctttgataccaactgagaccacgcagcagtttatcgtcaagaacggtattataaaggaagacgagctaaggggggaaaaccgtcagatcttaaaggacatcatggatgactactacagaggcttcataagtgagactttgtctagtatagacgacatcgactggaccagtttatttgagaagatggaaattcagttaaagaacggggacaataaagacacactaattaaagagcagaccgaatacagaaaagctatacacaaaaagtttgccaacgatgatagattcaaaaatatgttttcagcaaaattgatttccgacatattgccagaattcgtaatccataataacaattattctgcaagtgagaaggaagagaagacccaagtaatcaagctgttttcccgttttgctacgagtttcaaagattatttcaagaatagggctaattgtttctccgcggacgacataagtagcagttcctgtcacaggattgtgaacgataatgctgagatatttttttccaatgccctagtgtataggagaatagttaaaagcttaagcaacgacgatatcaataaaatttcaggggacatgaaggacagcttaaaggaaatgagtttggaggagatttacagttatgaaaaatacggagagtttataactcaggaaggcatctctttctataatgatatctgtgggaaggtaaactccttcatgaatttatattgccagaagaataaggaaaacaaaaatctttacaagcttcaaaagttacataagcagatcttatgtattgccgacacgagttatgaagtgccttataaattcgagagtgatgaggaagtgtatcagtctgttaacggattcctagataatataagttccaaacatatagtcgagaggctgaggaagattggcgataactataatggatataatcttgacaaaatctatatagtctctaaattttatgaaagcgtcagccagaagacatatagagattgggaaactataaacacagcccttgaaatacattacaataacatcctacccggcaatggtaagtctaaggcagacaaagttaaaaaagcagtaaagaatgacttacagaagtcaatcacggagataaatgagttggtcagtaactacaaattatgctccgacgataatattaaggccgaaacatatatacacgagataagtcatatattaaacaatttcgaagcccaggagttaaaatataaccctgaaattcatctggtcgaaagtgagttaaaggccagtgagttaaagaatgtacttgacgtaattatgaatgcttttcattggtgctccgtgttcatgaccgaggagttagtagataaagacaataacttttacgccgaacttgaagagatatacgacgagatttatccggtaatcagcttgtacaacttagttagaaattatgtaacacagaagccttactctactaaaaaaataaaactgaactttggtatcccaactcttgcagatggttggagtaaaagcaaggaatatagcaacaatgcgatcatcttgatgagagacaacttgtactatttgggaatcttcaacgcgaaaaataaacccgacaaaaaaatcatcgaagggaatacctctgagaataaaggtgactataagaaaatgatttacaatctacttcctggtcctaataaaatgatcccgaaagtgtttcttagttctaagactggtgtcgagacgtacaaacctagcgcgtacatcttagaagggtacaagcagaataaacacatcaaatcaagcaaagacttcgatattactttttgccatgacttgatagactactttaaaaactgcatagcaatccacccggagtggaaaaactttggctttgatttctctgacacctctacatatgaggacatatctggtttttaccgtgaggttgaattgcagggatacaaaattgactggacttacatatctgaaaaagatatcgatctattgcaggagaaaggccagctttaccttttccagatctataataaggacttctctaagaagtctacagggaatgataatttgcacactatgtacttaaaaaatctgttttccgaggaaaacttgaaagacattgttttaaagttgaacggagaagctgaaatatttttcagaaagagctccataaaaaacccgatcattcataagaagggatctatcctggttaacagaacgtacgaagcggaagaaaaagaccaattcggaaacattcaaattgttagaaagaatatccctgagaacatctaccaggagttatataagtattttaatgataagtcagataaggaactatctgacgaagcggcgaagcttaaaaatgttgtaggacaccatgaggctgctacaaatatagtcaaggactaccgttatacctacgataagtactttctacacatgcccattaccatcaattttaaagctaataaaacgggttttatcaacgatcgtatcctacaatatattgcgaaagagaaggatttgcatgtcattggcattgatagaggtgagaggaacctaatatacgtatccgtgattgatacgtgcgggaacatagttgaacagaaatcatttaatatagttaatgggtacgactatcagattaagctaaagcaacaagaaggcgccaggcaaattgcccgtaaagaatggaaagagatcgggaagatcaaggaaataaaagaaggatacctttccctggtcatccatgaaattagcaaaatggtgattaagtacaatgccataatcgcgatggaggacttaagctacgggttcaaaaaggggaggtttaaggtggagaggcaagtgtaccagaaatttgagaccatgctaatcaacaaactgaactacctagtttttaaggacatttcaattacagagaatggaggacttttaaagggttaccaactaacgtatataccagataagttgaaaaatgtcggtcaccagtgtggctgcatcttttacgttcccgccgcttatacatctaaaattgatccaaccacaggctttgtaaatatctttaaattcaaagatttaactgtggatgcaaaaagagagtttatcaagaaattcgatagcattcgttatgatagcgagaagaacctgttctgctttactttcgactataacaactttataactcaaaacaccgtgatgtcaaaaagctcatggtcagtctacacctatggtgtaaggattaaaaggcgtttcgtgaatgggagattctccaatgaaagtgacacgatcgacataacaaaggacatggagaagacactagagatgactgatattaattggagagacggacacgatctgcgtcaagatataattgattatgagatagtacagcacatatttgagatcttccgtttgactgtccaaatgcgtaattccctttctgagctggaagatagggactatgatagattaatatcccctgtactaaatgagaacaacattttctatgatagtgcaaaagccggggatgcattgccgaaagacgctgacgctaatggggcgtactgtatagctttaaaggggctttacgaaataaagcagataaccgaaaactggaaggaagatggcaaattctcaagggacaaacttaagatctctaacaaggattggttcgattttatacaaaacaaacgttatttgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 57 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaataatggtacaaacaactttcagaatttcattgggatctctagcttacagaagaccctgaggaatgcgttgattccaactgaaacaacccagcaattcatcgtgaaaaatgggataatcaaagaggatgagttaaggggtgaaaaccgtcaaatattgaaggatattatggacgactactaccgtggattcatctcagagacgttgagcagcattgacgacatagactggactagccttttcgagaagatggaaattcagttaaagaacggagataacaaagatacactaatcaaggaacagacagaatacagaaaagcaattcataagaaattcgctaatgacgatcgttttaaaaacatgttctctgcaaaattaattagcgacattctgccggaattcgttatacataataataactacagtgcttctgaaaaggaagagaaaactcaggtaataaaactgttctctcgttttgccacatccttcaaagactactttaaaaatagagcgaactgctttagcgccgacgatattagttcttcctcatgccacaggattgtcaacgataatgcagagatattcttttctaacgcactagtctacagaaggattgtaaagtctttgtcaaatgatgacataaacaagattagtggagatatgaaagactctctaaaggaaatgagccttgaggagatatactcttatgaaaagtacggtgagtttattacccaagaaggcattagtttctataatgacatttgtggaaaagttaacagttttatgaatctatactgtcaaaaaaataaggagaataaaaatctttataagttgcaaaaactgcataagcagatattatgtatagcagacacgagctatgaggtaccgtacaagttcgagagcgatgaggaagtctaccaatctgtcaacggatttttggacaacatttcttcaaaacatattgtggagaggcttaggaaaataggcgacaattataatggatataacttagataagatatatattgtttccaaattctacgaatctgtaagccagaagacatacagagattgggaaacgataaacacagcccttgaaattcactataacaacatactacctggaaacggcaaatcaaaggccgacaaagttaagaaggccgtaaagaatgatttacagaagagcataacggagatcaatgagctggtgtctaactataaattgtgtagcgatgacaacataaaagccgagacttacattcacgaaatttcacacatacttaacaactttgaagctcaggaattaaagtataatcccgaaatacaccttgtggagtccgaactaaaggctagtgagcttaagaacgtcctagacgtaattatgaatgccttccactggtgtagtgtttttatgaccgaggaacttgttgacaaagataataatttttatgcagaactagaagagatatacgatgaaatatacccggtgatcagtttgtacaatcttgtcaggaactatgtgacacaaaagccctattcaacaaagaaaataaaacttaatttcggaattcctacgttagctgatggctggtctaaatccaaggaatacagcaacaacgctataattctgatgagagataacttgtactatctaggcatcttcaatgccaaaaataagcctgataagaagattatagagggcaacacttcagagaacaagggcgactacaagaaaatgatctataacctattgcctggcccaaacaagatgattccgaaggtcttcctatcatccaagaccggcgttgagacatacaagccatcagcgtatattttagaggggtacaaacaaaacaagcacataaagtctagtaaagacttcgatataacattttgtcatgacttaattgactactttaagaattgcatcgctatacacccggaatggaagaatttcggcttcgacttctctgatacatctacctacgaggacattagcgggttttaccgtgaagtcgaattacaagggtataagatagattggacgtacatctctgagaaagacatagacttgcttcaggaaaagggccagttgtatctattccaaatatacaataaggatttttccaagaaatctacgggtaatgacaatcttcacacaatgtatcttaagaaccttttctcagaagagaacctgaaggacattgtcttaaaactaaatggcgaagctgagatttttttcaggaagtcttcaattaagaacccgataatccacaagaaggggagtattcttgtgaatagaacttacgaggccgaagaaaaagaccaatttggtaacatccagatagtcagaaagaacattccagagaacatctaccaagagctatacaaatatttcaacgacaagtccgataaggaactgtccgatgaggcagccaagttgaagaatgtcgtgggtcatcatgaagctgctactaacattgtcaaggactatcgttatacttacgacaagtatttcctacacatgccgataacaattaatttcaaggctaacaaaacaggctttatcaacgatcgtatcttgcagtacatagctaaggaaaaggatttgcatgtgattggcattgatagaggggagcgtaacttgatatatgtgtctgtcatagacacgtgtggcaacatcgtcgaacagaaatcattcaacatagtaaacggctacgattaccaaattaagctgaaacagcaagagggtgcacgtcaaattgcgcgtaaagagtggaaagaaattggtaaaatcaaggaaattaaagaaggctacttgtctcttgttatacatgaaatttccaagatggttataaagtataacgcgataattgctatggaagacttatcatacgggtttaaaaaggggaggttcaaggtagagaggcaggtctatcaaaagttcgagacgatgttgattaataaactaaactatctagtgttcaaagatatcagcattacggagaacggggggctactgaaaggatatcaactaacgtacattcccgataagttaaagaacgttggtcatcaatgtggttgcatcttctacgtgcctgctgcctatacgtccaaaatagatccaactactggatttgttaacatctttaaattcaaagatttaaccgtagacgccaaaagggaatttataaaaaaatttgacagcatccgttacgatagcgaaaagaatctgttctgttttactttcgactacaataatttcatcacgcaaaatacggtaatgtctaagtcaagttggagcgtctacacgtatggagtcaggatcaagaggcgtttcgtaaatggaagattctctaatgagtcagatactatagacatcacgaaagatatggagaaaaccttggagatgacggatattaactggcgtgatggacacgatttaagacaggacattattgactatgagattgtgcaacacatcttcgaaatattccgtctaacagtccaaatgaggaatagcctaagtgaattggaggaccgtgattacgataggcttataagtcctgtccttaacgaaaacaatattttctatgatagtgctaaggcgggggacgcactgcctaaagacgcagatgctaacggggcatactgcattgcgttaaagggtctgtacgaaatcaagcagattacggaaaactggaaagaggatggcaagtttagcagagataagttgaagataagtaacaaagattggtttgactttattcagaataaaaggtatttaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 58 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaataacggcactaataatttccagaatttcatcggcattagcagcttacaaaagacgttgaggaatgccttaatacccacagaaactactcaacaatttatagtgaagaatgggataattaaggaagacgagttgagaggtgaaaataggcaaatcttgaaagacattatggatgactactacaggggcttcattagtgaaacgttgtcttcaatagatgacattgattggacttctttgtttgagaagatggaaatacagttaaagaacggcgacaataaggatacacttatcaaagagcaaacagaatatagaaaagcaattcacaaaaagtttgctaacgatgataggttcaagaacatgtttagcgctaaactaatatcagacatccttcccgagttcgttattcataacaataactatagtgcaagtgaaaaagaggagaagacacaggtgattaagctgttctccagattcgcgacttctttcaaagattacttcaaaaacagagccaactgtttttcagctgacgatatctctagtagtagttgtcaccgtatagtgaacgataacgctgagatcttctttagcaatgcattagtgtatagaaggatagttaagtctctaagcaatgatgatatcaataaaatttccggagacatgaaggactccctaaaggaaatgtccttagaagagatctactcatatgagaaatacggggaatttattacgcaggaagggatctccttttacaatgacatatgcgggaaggtcaactctttcatgaacttatactgccaaaagaacaaggagaacaagaatttatataaacttcagaaacttcacaaacaaatactgtgcatagccgatacctcatatgaggttccttacaaatttgaatcagatgaagaggtataccaatccgttaacggctttcttgacaatattagctcaaagcacatcgtggagaggttgagaaagattggtgataattataatggctacaatctagataagatatatattgttagcaagttctacgagtctgtgtcccaaaaaacatatagggattgggagacaattaatactgctctagaaatccattacaacaacatccttcctggaaatggcaagagtaaggccgacaaagtcaagaaagcagtgaaaaatgatctgcaaaaatcaattactgagataaacgagctagtatctaattacaagctttgtagcgacgataacattaaggcagaaacgtacatacacgagattagtcacatcttaaataattttgaagcccaagaactgaaatataaccctgagatacaccttgttgaatccgagttaaaggcgtctgaactaaaaaacgtgttagacgttattatgaatgccttccactggtgtagcgtctttatgactgaggagttggttgataaggataataacttttacgctgaattggaagaaatttatgacgaaatctatcctgttatttctctatataatttggtgagaaattacgtaacgcaaaagccctatagtacgaaaaaaataaaactaaatttcgggatccctaccctagccgacggttggtctaaatccaaggagtactcaaacaatgcaataatattgatgagggacaacctgtactacctaggcatatttaatgccaaaaataagcccgataaaaagattatagaagggaacacgtcagaaaataaaggagactataagaaaatgatctacaaccttttgcccggccccaataaaatgatcccgaaggtcttcctaagtagcaagactggcgtagagacctacaaaccatctgcatacattttggaggggtacaagcaaaacaagcacataaagagtagtaaggattttgacattacattctgccatgacttaattgactactttaaaaattgcatcgcaattcaccctgaatggaaaaattttggatttgatttctctgatacttcaacatatgaggatatttcagggttctacagggaggtcgaactacagggttacaaaatagactggacgtatatttctgagaaagatatagatttgcttcaggaaaagggtcagctatatctgttccagatatataataaggacttctccaaaaagagtaccggaaatgataatctgcacacaatgtacttaaaaaacttgttctctgaggagaatctaaaagacatcgtactaaaacttaacggggaggccgaaattttttttaggaagtccagcatcaagaacccgattattcataaaaaaggtagcattttggtgaaccgtacttatgaggcggaagaaaaagaccaattcggtaatattcaaatcgttagaaagaacatccctgagaacatttatcaggaactatacaaatactttaacgacaaatcagataaggagctttctgatgaggcagctaaattgaaaaatgtagtgggacatcacgaagcagccactaacatagtgaaggactacagatacacatacgataagtacttcctgcacatgcctattacaattaactttaaagcaaataaaacagggtttattaacgacagaatcttacagtatattgccaaagaaaaggatctgcatgtgataggaatagacagaggagaaagaaacctgatatacgtctccgtgattgatacatgtgggaacatagtagaacagaagtcctttaacattgttaatgggtacgattatcaaattaaattaaaacaacaagaaggagcacgtcaaatagctaggaaagaatggaaagagataggaaaaattaaggaaattaaggagggttacctgtcccttgtaattcatgaaatatccaaaatggtaattaaatataacgcgatcatcgcgatggaagatctaagctacgggttcaaaaaaggcaggtttaaggtggagaggcaagtttaccaaaagttcgagacaatgttgattaataagttaaactacttagttttcaaagatatctccataaccgagaatggcgggcttttaaaagggtaccaactaacatatatcccggataaattgaagaacgttggacaccagtgtggctgcatattttatgtacccgctgcgtatacttctaaaattgacccgaccaccgggtttgtaaacatattcaagtttaaggacctaacagttgacgccaaacgtgagttcatcaagaagttcgatagtataaggtatgactctgagaagaaccttttctgcttcacgtttgactataataatttcatcacccaaaatacagttatgtcaaaaagctcttggtcagtatatacgtatggcgtaaggattaagcgtaggttcgtgaacggtagattttccaacgagtcagatactattgatattaccaaggatatggagaagacattagaaatgacagatataaattggagggatgggcacgatctaaggcaagatatcattgattacgaaattgttcagcacatattcgagatattccgtcttacagtacaaatgcgtaacagcttgtctgagttggaagatcgtgactatgacaggttgatatcaccggtcttgaacgagaacaatatattctacgacagcgctaaggcgggagacgctctgcctaaagacgcagatgccaatggggcgtactgcattgccttaaaaggcttatacgagattaaacagatcacagagaactggaaagaggacggcaagttttctagagataaattgaaaatctcaaacaaagactggttcgatttcatccaaaacaaaagataccttaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 59 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaacaatggaactaacaacttccagaactttatcggcatctcttccctccaaaagacactgagaaatgcactgatcccaaccgaaacgactcaacaatttattgttaagaacggcatcataaaagaagacgagcttcgcggcgagaaccgccagatacttaaggatattatggacgattattaccgaggctttatcagcgaaactcttagctctattgatgatatcgactggacctccctcttcgaaaaaatggagatacagctcaagaacggcgataataaagacaccttgataaaggaacagactgagtacaggaaagcgatccacaagaaattcgcgaacgacgacaggtttaaaaacatgttctctgcaaaattgatatccgacatcttgccggaatttgtgatacacaacaataactatagcgcttcagagaaagaagagaagacccaagtaatcaagttgttcagccgcttcgcaacgtcttttaaagattactttaagaaccgggccaattgtttctccgcggatgatattagctcatcaagttgccatcgaattgtcaatgataatgcggagatcttcttcagcaatgcgctggtctacagacgaatcgtaaaaagtctttcaaatgacgacatcaataagattagtggagatatgaaggattcccttaaggaaatgagtcttgaagaaatatactcatacgaaaagtacggggaatttattacccaggaggggatctccttctataacgacatctgtggaaaagtaaactcattcatgaacctgtactgtcagaaaaacaaagaaaacaaaaatctgtataaactccaaaaattgcacaagcaaatattgtgtatagcggacacatcatacgaggttccatataagttcgaaagtgatgaagaagtctaccaatcagtgaatgggtttctggacaacattagttccaagcacatagttgaacgactgcgaaagattggtgacaattacaacggctataatttggacaagatttatatagttagcaaattttatgaatccgtatcacaaaagacttatagagactgggaaacaatcaacacggcacttgagatccattataacaatattcttccagggaacggcaaaagcaaggctgataaggtaaaaaaggccgttaagaatgatcttcaaaaatccataacggagatcaacgaacttgtaagtaactacaaattgtgctctgacgacaatataaaggctgaaacgtatattcacgagattagccatatcctgaataactttgaggcccaagaactcaagtataacccggaaatacatttggtagaaagcgagcttaaagcgagtgagctgaaaaacgtcctcgatgtgatcatgaatgctttccactggtgtagtgtctttatgactgaggagttggttgataaagacaataatttctacgctgaactggaagaaatttacgacgaaatctatccagtgatctccctctataacctcgttcgaaactacgtgacgcagaaaccttattctacaaagaaaattaagttgaacttcggcattcctacacttgctgacggatggtccaaatccaaagagtactcaaacaacgcaatcatcctcatgcgggataacctttattatttgggcattttcaacgccaaaaacaaacctgataaaaagataattgaaggcaatacgagtgagaacaagggcgactacaaaaaaatgatatataacttgttgccaggccccaacaagatgattcctaaagtttttctgtcttctaagactggagttgaaacttacaaaccctccgcctacattcttgaagggtataaacagaataagcacataaagtcctcaaaggatttcgacattacgttttgccatgacctcatcgactatttcaagaactgtatcgccatacatccggagtggaagaattttggatttgatttctccgacacatctacctatgaagacataagcggtttctaccgggaggtcgagcttcagggctataagatagattggacatacattagtgaaaaagatatcgatcttctgcaagaaaagggacaactttacctttttcagatttataataaagacttttcaaaaaagtccacagggaacgataatctgcacaccatgtatctcaagaatctgtttagtgaagaaaaccttaaagacatagttttgaagcttaacggagaggctgagattttttttagaaagtcctcaattaaaaaccctataatacacaagaaaggctctattcttgttaacaggacatatgaagccgaggagaaagatcagtttggcaatatccagattgttcgcaagaatatcccggaaaatatatatcaggagctgtataaatactttaacgacaagagcgacaaggagctgagtgacgaggccgcgaagcttaagaatgtagtaggtcaccacgaagcagccaccaatatcgtcaaagactataggtacacgtacgacaagtactttttgcacatgcctataactataaacttcaaagctaataaaactgggtttattaatgacaggattctccaatacatcgctaaagagaaggatctgcatgtaattggcatagacagaggtgagagaaacttgatatatgtcagcgtaatagacacatgtggcaatatcgtggaacagaagtcttttaacatcgtcaatggttacgactaccaaattaagttgaaacagcaggaaggcgcacgacagatcgcacgaaaggaatggaaagagataggcaaaataaaagaaataaaggagggctatctcagtctcgttatacacgaaatttcaaaaatggttattaagtacaatgcaatcatagcgatggaggatctcagttatgggttcaaaaagggtcggtttaaagttgagcgccaagtgtaccaaaagttcgagacaatgctgattaacaagctgaactacctcgtcttcaaagatataagtattacggagaacggtggccttcttaaaggctatcaacttacttacatcccggacaagctcaaaaacgtagggcaccaatgcgggtgtattttctatgtgcctgcggcatatacgtcaaagattgacccaaccacaggattcgtaaacatattcaagtttaaggacctcaccgttgatgcgaaaagggagttcattaaaaaatttgattctattcgatatgatagtgagaaaaatctcttttgtttcacatttgactataataattttattactcagaatactgtcatgagcaagtcatcttggtcagtgtacacatacggggtgcggatcaaacgcaggttcgtcaatggtcgcttctcaaacgaatcagacaccattgacatcacaaaggacatggaaaaaacccttgagatgaccgacattaattggcgcgatggtcatgatctgcggcaagacatcatagactacgaaatcgtccaacacatctttgagatctttcgcttgacggtccaaatgcggaactccctgtccgagctcgaggatagagattatgatcggctgatatctcccgtgcttaatgaaaataacatcttctacgactccgccaaggcgggtgatgccctgccgaaggatgcggatgctaatggcgcttattgcattgctcttaaggggctctatgagataaagcagatcacggaaaactggaaagaagacggtaagtttagtagagacaagctgaagatctcaaataaagactggtttgatttcatacagaacaagcggtacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 60 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaacaatggcactaacaattttcagaatttcatcggcatttcaagtctgcaaaaaactctgaggaatgctttgatccctactgaaaccactcagcaatttatagtcaagaacggtataattaaagaagatgaactcaggggtgaaaatagacaaatactcaaggacattatggatgactattatagaggcttcatctcagagactctctcatcaatagatgatatcgattggactagccttttcgagaaaatggagattcagttgaaaaatggtgataacaaagatacgttgataaaggaacagaccgagtacaggaaagccattcataagaaatttgctaatgacgatagatttaagaatatgtttagtgcaaaactgattagtgacattctgccggagttcgttatccataataataactactctgcatccgaaaaggaggaaaagacgcaagttattaaactgttcagccgcttcgccacaagcttcaaggactacttcaaaaatagagccaactgcttttctgccgacgatatatcatcatcttcatgccatcggatcgttaacgataacgccgagatattcttcagcaacgcccttgtatatcgaagaatagtcaaaagtctgagtaatgatgatattaataaaattagcggtgatatgaaagactccctgaaggaaatgtcactggaggaaatttatagttacgaaaagtacggcgaattcattactcaagaaggcatatccttctataacgacatttgcggaaaggtcaactcattcatgaacctttattgccagaagaataaggagaataaaaatctttacaaattgcaaaaacttcacaaacaaattctttgcatcgcggatacgtcctacgaagttccttacaaatttgaatccgatgaggaagtgtatcagagtgtcaatggatttttggataatatctcttcaaaacatattgtggagagattgcgcaaaataggtgataactacaatggctacaacctggacaagatttatattgttagcaagttctatgaaagtgtcagtcaaaagacctacagagattgggagacaatcaacacggcgctcgaaatacactacaataacatcctccccggcaatgggaagagtaaagccgataaggttaaaaaagctgttaagaacgacctccagaaatccatcacggaaataaacgagctggtttccaactataagctgtgtagcgatgataatattaaggctgagacatatatacatgagatcagccacattctcaacaatttcgaggcacaggaactcaaatacaatcccgagattcacttggtggaaagtgagttgaaggcgtcagagcttaagaatgtacttgacgtaataatgaatgcttttcattggtgctccgtgttcatgactgaggaactcgtggataaggataataacttttatgcggagttggaagagatatacgatgaaatatacccggttatctcactgtataatctggtcagaaattacgtgacccaaaagccttatagtacaaaaaaaataaagttgaacttcggtattccgacattggcagatggttggtccaaaagcaaagaatactctaataacgccattatattgatgcgagacaatttgtattaccttgggatctttaacgcgaaaaacaaaccggataagaagatcatcgaaggtaatacatctgagaataagggggattacaagaagatgatttataatctgttgccggggccaaacaagatgattccgaaggtctttctgtcatctaagacaggagtagagacctacaaaccttctgcgtacattttggaaggctacaaacagaacaagcatataaaatctagcaaggactttgatatcacgttttgtcatgatctgatagattatttcaaaaactgcatcgctatacatcctgagtggaagaatttcggctttgacttttctgacaccagcacatacgaagacatctcaggtttctaccgggaagtcgagctccaggggtacaagattgactggacatatataagtgaaaaagacatcgacctcctccaagagaagggccaactttacctgttccagatctataacaaagacttttctaaaaagtccacgggtaacgacaacttgcacactatgtatctgaaaaacttgttctctgaagagaacctcaaggacatcgtcctgaagcttaacggggaggcggagatcttctttagaaagtcctctatcaaaaatcccattatccataaaaagggctctatactcgttaataggacatatgaagcggaggaaaaagatcaatttgggaacatccagatcgtccggaaaaatatacctgagaatatctatcaagagctgtacaagtattttaatgataagtcagacaaagagctcagtgatgaggcggcaaagctcaagaacgtggtggggcatcatgaagctgcgacgaacattgtcaaagattatagatacacttacgataaatacttcctccacatgccgataacgattaacttcaaagccaataagacggggtttataaatgatcggatccttcagtacattgcgaaagagaaagacctccatgtgatcggaattgaccgaggagaaaggaatctgatttacgtgtccgtgattgatacttgcgggaatatagtcgagcaaaagagtttcaacatagtcaacgggtatgactatcagataaagctcaaacagcaggaaggtgcgaggcaaattgcgcgcaaagagtggaaggagataggcaagattaaagaaatcaaggaaggttatctcagcttggtgatccatgaaatatctaagatggttataaagtacaatgccataatagccatggaggatctttcctacgggtttaagaagggccgatttaaagtggagcgacaagtttaccagaagttcgaaaccatgttgattaacaaacttaactatttggtgttcaaggatataagtataaccgaaaacggcggtttgcttaagggttatcagctcacgtatattcctgataaacttaaaaacgttggacaccagtgtggatgtatcttctacgtgccagccgcttacactagtaagatagatcctaccacggggtttgtgaatatttttaagtttaaagacttgacagtcgacgccaaaagggaatttataaaaaagtttgattctatccgctacgatagtgaaaaaaatctcttttgctttactttcgactataacaacttcattacgcagaacactgtcatgagtaagtccagctggagcgtctacacatatggcgtccgaattaaacgacgatttgtaaacgggcggttttcaaacgaatctgacacgatagacattaccaaggatatggagaagacacttgagatgaccgacataaactggcgggacggtcacgatcttcggcaggacataattgattacgaaatcgtccagcatatattcgaaatatttcgacttacagtgcaaatgcggaacagtctctctgaactggaagatcgcgattatgaccggttgatttctccggtcctcaatgaaaataacatattttatgatagtgctaaggcaggtgatgcgttgccaaaggatgcagacgctaatggtgcctattgtatcgcgctcaagggattgtacgagataaagcaaattacggagaactggaaggaggatggtaagtttagccgagacaagttgaagattagcaataaagactggtttgattttatccaaaacaagaggtacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 61 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaataacggaactaataactttcaaaatttcataggtatttcaagcttgcagaagaccctgaggaatgccctgattccaaccgagacaacgcagcagttcatagtcaaaaatggcattattaaggaagatgagctgcggggggaaaaccgacagatactcaaggatattatggacgactattaccggggatttatctcagaaacgctgagcagtattgatgacatcgattggaccagtcttttcgagaaaatggaaattcaacttaagaatggtgacaataaagacactctcataaaggagcaaactgaataccgaaaagccatacacaaaaagtttgccaacgatgaccgctttaaaaacatgttttcagctaagctcattagcgacattctccccgagtttgtgattcataacaataactatagcgcatccgagaaggaggaaaaaacccaagttatcaaattgttcagtagattcgctacgagctttaaagattactttaaaaaccgggctaactgcttcagtgcagacgatatcagctcctcatcctgtcatcgcatcgtcaatgataatgctgagatcttcttttctaatgcactggtttaccgcaggatagttaagtctcttagtaacgacgacatcaacaagatatcaggagatatgaaggattcccttaaagaaatgagtctcgaggagatatattcttatgaaaaatacggcgaatttattacccaagagggcattagtttctataatgacatatgcggaaaagttaatagttttatgaatctctattgtcagaagaataaggagaataagaacctctacaaattgcagaagttgcacaagcaaattctgtgtatcgcggacacctcttacgaggtcccatataagttcgagagtgatgaagaagtataccagagcgttaatgggttcctggacaacatctcaagtaaacacatagtcgaaaggctccgaaagatcggtgataactataacggatataatttggataaaatttatatagttagcaaattttacgagagcgtcagtcagaagacctaccgggactgggagaccataaacacagcgctggaaatacattataacaacatactgcctgggaacggtaagtcaaaggcagacaaggttaaaaaggctgtgaagaatgacctgcaaaaatcaattacagaaataaatgagttggtaagtaattacaaactttgcagcgatgataatataaaggcagagacgtacatacatgaaatatctcatatcctcaacaatttcgaagcccaagaactgaagtacaacccggaaattcatcttgtagagtctgagttgaaggcctccgaattgaaaaacgttcttgacgtaattatgaatgccttccactggtgctcagtattcatgacggaagagctcgtggataaagacaacaatttttacgctgaactggaagaaatatatgacgagatttaccccgtaatttcactctacaacttggtacgaaattacgttacccaaaagccatactcaacaaaaaaaattaaactgaacttcgggatacccaccctcgcagatggatggtcaaagtccaaagagtacagtaacaatgcaattatcctgatgcgagacaacctttattacctcgggattttcaacgctaaaaataaacctgataaaaaaataattgagggtaatacctctgaaaacaagggggattataaaaagatgatatacaatctgctgcctggcccgaacaaaatgattcctaaagtcttcttgtcttccaagactggagtcgaaacctacaagccaagtgcttatatactcgaagggtacaaacaaaataagcacataaaatccagcaaggattttgatattacattctgccacgatttgattgattattttaagaactgtatagccatccacccagaatggaagaattttggttttgattttagcgatacctcaacatatgaggatatctctggcttttaccgcgaggtagaactgcaaggttataagatcgattggacttatatttctgaaaaggacatagatctcctgcaagagaaagggcaactttatttgtttcaaatatacaacaaagattttagtaagaagagtactggcaatgataaccttcacactatgtatctgaagaaccttttttctgaggagaacttgaaggacatagtccttaaactcaatggggaagctgaaatattctttcgcaaaagctccattaaaaacccgatcattcataaaaagggttccatcttggtaaaccgcacatacgaggcggaagaaaaagatcagttcggaaatatccagatcgtaaggaagaatatccccgaaaatatataccaagagctttacaaatattttaacgataagtcagacaaggaactgtcagacgaagcagccaagttgaagaatgtcgtagggcaccacgaagcagctacaaacatagttaaagattatcggtacacctacgataaatatttcctgcatatgccaataaccataaacttcaaagccaacaaaacagggttcatcaatgaccgaatacttcagtatatagccaaggaaaaagacctgcatgttataggaatagatagaggtgagcgcaacttgatatatgtcagcgtgatagacacctgcggaaatatcgtcgagcaaaaaagtttcaacattgttaatggctacgattaccaaattaaattgaagcagcaagagggggctcggcaaatcgcgcgaaaggaatggaaagaaatcgggaagattaaagaaattaaagagggctacctgtctcttgtaattcacgaaatatctaagatggtcatcaagtataatgccattattgcgatggaagatctgtcctacggatttaagaaaggcaggtttaaagtcgaaaggcaggtgtaccagaaattcgagaccatgctgattaataagctcaactatctcgtatttaaggatatttctataactgaaaatggagggcttctcaaaggatatcaactcacatacatacctgataagctgaagaacgtaggccaccagtgtggatgcatattctatgtaccagctgcatacacaagcaagatcgatccaactactgggtttgtcaatatcttcaaatttaaggacttgacggtcgatgccaaacgggagttcatcaaaaagtttgatagtattcgatatgatagtgagaagaacttgttttgcttcacatttgactacaacaatttcataacgcaaaatacggttatgtctaaatcctcatggagcgtctacacttacggagtgaggataaagcggcgcttcgtaaatggcaggtttagcaatgaatccgacacgattgacataaccaaggatatggagaaaaccctcgagatgaccgatataaattggcgggatggacacgatctgcgacaagacataatcgattatgaaatcgtgcagcacatatttgagatattcaggcttacggtccaaatgagaaattccctttccgaacttgaagaccgcgattacgaccgactgataagccccgttctgaacgaaaataacatcttctacgacagcgctaaagcgggagacgcgctgccgaaagatgcggacgcaaatggagcctattgtatcgccttgaaagggttgtacgagatcaaacagataaccgagaattggaaggaggatgggaagtttagtcgagacaaacttaaaataagcaacaaggactggttcgactttattcaaaacaaacgatatctcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 62 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaataatggtactaacaattttcaaaactttatcggcatctcttcacttcagaaaactcttcggaacgcccttataccgacggagacaacgcagcagtttatagttaaaaacgggatcattaaagaagatgaactcagaggggaaaacaggcaaatattgaaggacattatggacgattactaccgggggtttatttcagagaccctttcatctattgatgacatagattggacctcccttttcgagaaaatggagatacaattgaaaaacggcgacaataaagatacacttatcaaggaacaaactgagtatcgcaaggcgattcacaagaagtttgcgaatgacgatcgctttaagaatatgttttctgcgaagctcataagtgacattctgcctgaatttgtcattcataacaacaattattctgctagcgaaaaagaggaaaaaactcaagtcattaagctttttagcaggttcgctactagttttaaagactattttaagaaccgggcgaattgctttagcgctgacgacatatcatcctcatcctgtcatcgcatagtcaatgataatgcagaaatattcttttctaatgcgctcgtgtatcggagaatagtgaaaagcctctctaacgatgacattaacaaaataagcggcgatatgaaggatagtctgaaggaaatgtccctcgaagaaatatactcatacgagaagtacggagaatttatcacccaggaaggaattagtttttacaacgacatctgtggtaaggttaactcttttatgaatctgtattgtcaaaagaataaagaaaataaaaatctttataagctccaaaagcttcacaaacaaatcttgtgcattgcggatacgtcatacgaagtaccttacaaatttgaaagcgacgaagaggtgtatcagtcagtgaatgggttccttgacaatatttctagcaaacatattgtggagcgacttcgaaagatcggtgataattacaatggctataatttggataaaatttacatagttagtaagttttatgaatccgtctcacaaaagacgtaccgagattgggagaccatcaacactgctctggagattcattacaataatatattgcctgggaatgggaagtcaaaggccgacaaggttaaaaaagccgtaaaaaacgatcttcaaaagtccattaccgagataaatgaacttgtatccaactataagttgtgctctgacgataatattaaagcagaaacgtatatccacgaaataagtcacatcctgaacaacttcgaagctcaagagctcaagtataatcctgaaattcatctcgtcgaaagcgagctgaaagcatccgagttgaagaatgtgcttgatgtgatcatgaacgcattccattggtgcagtgtgttcatgaccgaagaacttgtagacaaagacaacaacttctacgctgaattggaagagatttacgatgaaatttaccccgtgatatccctctataatctggtaagaaattacgtcacgcaaaaaccatacagtaccaagaaaataaagctcaactttggtattccgacgttggcagatgggtggagtaagagcaaggagtattctaacaatgcaatcatcctcatgcgcgacaatttgtattatctggggatcttcaacgcgaaaaataagcccgacaaaaagataatagaaggcaatacgtccgagaacaaaggggactataagaaaatgatttataaccttcttccaggacccaacaagatgatcccaaaggttttcttgagttcaaaaaccggcgtagaaacttataaaccgtccgcctacattctggaagggtacaagcaaaacaagcacattaagtcatctaaggatttcgacattactttttgtcatgatttgatagactacttcaaaaattgtatagcgatacatccggaatggaaaaattttgggttcgatttttccgacacaagtacttatgaagacatctcagggttttatagggaagttgaactgcaaggttacaaaatagactggacttatattagtgagaaggacattgatttgctccaggaaaagggtcaattgtatctgttccagatatataacaaggatttctctaaaaaatctacaggtaacgacaatctccacacgatgtacctcaagaatctcttcagcgaagagaatttgaaggatatcgtacttaagctcaatggagaagcggaaatattcttcagaaagtccagcattaagaatcctataattcacaagaaagggtcaattctcgtaaaccggacttatgaggccgaagaaaaagatcagtttggtaacattcagattgtacggaaaaacattcccgagaacatctatcaagaactgtataaatactttaatgataaatccgacaaggaactttctgacgaggctgcaaaattgaagaacgtagtgggacaccatgaggccgcaaccaatatagtaaaggattacagatacacttatgataagtatttcctccatatgccgatcacgattaatttcaaggcgaataaaaccggcttcattaacgatcgcattttgcaatatattgcgaaggaaaaggatttgcacgtgataggtatagaccggggtgaacgaaacttgatttacgtctctgtgatcgacacatgcggaaatatagttgaacagaagtcctttaatattgtgaatggttacgactaccagataaaattgaagcaacaggagggcgcaagacagatagctcgcaaagagtggaaggaaatcggcaagatcaaagaaataaaggagggttatctttccctggtaattcatgaaattagcaagatggttattaagtataatgctataatagctatggaggacctttcctatgggttcaagaaaggtcgcttcaaagtggagcgacaagtgtatcaaaagttcgagactatgttgataaataaattgaattatttggtttttaaagacatttcaataactgagaacgggggtctcttgaaggggtaccaattgacttatattccggacaagttgaagaatgtcggacaccagtgtggttgcattttctacgtgcctgccgcttacacctcaaaaatcgatccgaccactggttttgtaaatatatttaaattcaaagatctcaccgttgatgccaaacgggagtttatcaaaaaattcgattccattcgctacgactctgagaaaaaccttttttgtttcacgttcgattataacaactttataacccaaaatactgtaatgtccaagtcaagttggtctgtctatacttacggagtaaggatcaagcgccgcttcgttaatgggagattctcaaacgagtctgataccatagacataactaaagacatggaaaaaaccctggaaatgacggacatcaattggcgagacgggcatgatcttcgacaggacataatagattacgaaattgttcaacacattttcgagatatttcgacttacggttcagatgaggaattccctttccgaattggaagaccgggattatgatcgacttatatctcccgtgctcaatgaaaacaatattttttatgattcagcgaaagctggggacgcgctgccaaaagatgccgatgccaatggagcatactgtatcgccctgaagggtttgtatgagattaagcaaattactgaaaactggaaggaagatggcaagttttctagagataagcttaagattagcaataaggactggtttgacttcattcaaaataaaaggtatcttaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 63 - DNA, 4029 bp, Artificial Sequence
  Description of Artificial Sequence: Synthetic polynucleotide
atgggccatcatcatcatcatcacagcagcggcgtcgatctgggtaccgagaatttgtatttccagagcccagcggctaaaaaaaagaaactggatggcagcgtggatatgaataatggaacaaataattttcaaaattttattggtatcagttcattgcaaaagactttgagaaatgctttgatcccgactgagaccacacagcagttcatcgtcaaaaatggcataatcaaggaagacgaacttaggggtgagaatagacaaatattgaaggacatcatggatgactattatagggggttcatttccgaaacgctcagtagtattgatgacattgactggactagtcttttcgagaaaatggaaattcagcttaagaacggggacaataaagacacgctgatcaaggagcaaacggaatataggaaggcgatccataaaaaattcgcgaatgatgatcggtttaaaaacatgtttagtgccaagttgatcagcgacatactgcccgaattcgtgatccacaacaataattacagcgcctccgaaaaggaggaaaaaactcaggtcattaaattgtttagccgattcgcaacgagtttcaaagattattttaagaaccgggccaactgtttttcagcggatgatattagctccagcagctgccatcgcatagtaaatgataacgctgaaatcttttttagcaacgcacttgtctaccggaggattgtaaaatcactgtcaaatgatgacattaacaaaatatctggagatatgaaggactcactcaaagaaatgagcctggaagaaatatattcatacgaaaaatacggggagtttattacccaggaaggtatcagtttttataatgatatatgtggaaaagttaattcatttatgaatctttactgtcaaaaaaataaggagaacaagaatttgtacaagctccaaaaacttcataaacagattctgtgcatcgcagacacaagttatgaggtaccgtacaaatttgagagcgacgaagaagtttatcagagtgtgaatggtttcctggacaatatctcttctaaacacattgttgagaggcttaggaagatcggtgataattataacggctataatctggacaaaatttatattgtatcaaagttttatgaatcagtctctcaaaagacgtatcgggattgggaaacaattaacacggctctggagatccactacaataacattctgcccggcaacgggaagagcaaagctgataaggtcaagaaggcagtcaagaacgaccttcagaagagcataacagaaattaacgaattggtcagtaactacaaactgtgtagtgatgacaacataaaagccgaaacatacatccatgaaataagccatatcctgaataacttcgaagcccaagaacttaaatacaatcccgagattcatcttgtcgaatcagaactcaaggcgtccgagctcaaaaatgtccttgacgtgataatgaatgccttccactggtgcagcgtattcatgacggaggagttggtagataaagacaacaacttttatgccgaattggaagagatttatgatgagatttaccccgttatttctctgtacaacttggttcgaaactacgtaacacaaaaaccatactcaaccaaaaagatcaaactcaattttggcatacctacattggctgatggttggtccaagtcaaaggaatatagcaataatgcaataattctcatgcgagataacttgtattatttggggatctttaacgctaagaacaaaccagataaaaagataatcgaggggaacacaagtgagaacaagggtgattacaaaaaaatgatttacaatctgcttcctgggcctaacaaaatgattccgaaggtgtttcttagctctaaaactggagtggagacgtataagccttccgcgtacattctcgaaggctacaagcaaaataagcatatcaagtccagtaaggacttcgacatcactttttgccacgatctcatcgattactttaagaactgtatcgcaatacaccccgagtggaaaaactttggttttgatttttcagacactagtacctacgaggacatttccggcttctatcgagaagtcgaactccagggctacaaaatcgattggacgtacatttctgagaaggacatcgacttgctccaagagaaaggtcaactttacctcttccaaatttacaataaagacttttcaaagaagagcaccggtaatgacaacttgcataccatgtatctgaagaacctgttttctgaggagaacctcaaggatattgtattgaagttgaatggcgaagcagaaatatttttccgaaagtcatctatcaagaaccccattatacacaaaaaaggctctatcctggtgaaccggacttacgaggcagaggagaaggatcaattcggaaacatacagatagtccgcaaaaacatccctgagaatatctatcaggaactctataagtacttcaatgataaatcagacaaggagcttagcgacgaagcagctaaacttaaaaacgtggttggccatcacgaggccgctaccaacatagtcaaagactaccgctatacttatgacaagtactttttgcacatgcccataacaattaatttcaaagctaacaaaacagggtttataaatgacagaatcctccaatacatcgccaaagagaaggacctccatgtaatcgggattgatagaggcgaacggaacttgatttacgttagtgtcattgatacctgtggtaacattgtcgaacaaaagtcattcaacatagtcaatggatatgattatcagataaaactcaagcaacaagaaggcgcgaggcagattgccaggaaggaatggaaagaaatcgggaagatcaaggagatcaaggagggttacctgtccttggtgatacacgagatttcaaaaatggttataaaatacaatgccattatcgcgatggaggatttgtcttatggatttaagaaggggaggttcaaagtcgaacgacaagtctatcagaagtttgaaacaatgctcattaacaagctcaattaccttgttttcaaggatataagcatcactgaaaacggcggactccttaagggatatcagctgacttatatccccgacaagctcaagaacgtagggcaccaatgcggatgcatcttttacgtgcctgcagcatatacttcaaaaattgatccgactactggctttgttaacattttcaagttcaaggatctgacggtagacgctaagagagaattcataaaaaagtttgacagcatcaggtacgatagtgaaaagaaccttttttgttttacctttgactacaataattttattacgcaaaatacagttatgagcaaatcaagttggagcgtttacacatatggcgttcggatcaagcgcagattcgtcaatggtcgcttctcaaatgagagcgatacaatcgatataacgaaggatatggagaagacgcttgagatgacagatatcaactggcgggacggacatgaccttagacaagacataatcgattacgaaatagtacagcatatctttgagatttttaggcttacagttcagatgcggaactctctttccgaactggaggaccgggattatgatcggttgatctccccagtactgaacgaaaataatatcttttacgatagcgcgaaggctggtgatgcactcccaaaagacgctgatgcgaacggagcttattgcatagcccttaaagggctttacgagattaaacaaataacagaaaattggaaggaagatggcaaattttcccgcgacaagttgaagattagtaacaaagactggttcgacttcattcagaataaacgctacctcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 64 - DNA, 3963 bp, Artificial Sequence
  Description of Artificial Sequence: Synthetic polynucleotide
agcccagcggctaaaaaaaagaaactggatggcagcgtggatatgaataacggtaccaataacttccagaacttcatcggtatttctagcctgcaaaagaccctgcgtaacgcgctgattccgaccgagactacccagcaattcatcgtgaaaaacggtatcattaaggaagatgaattgcgcggtgagaatcgtcagattctgaaagatatcatggatgactactatcgcggtttcattagcgaaaccctgtcgagcatcgatgatatcgattggacgagcctcttcgagaaaatggaaattcaactgaaaaatggtgacaacaaagataccctgattaaagaacaaacggaataccgcaaggcaatccataaaaagtttgcgaatgacgaccgttttaagaatatgttctcggccaagctgatttccgacatcctgccagagttcgtcattcacaacaacaattacagcgcaagcgagaaagaggaaaagactcaggtcattaagctgtttagccgctttgcgacgtccttcaaagactacttcaagaatcgtgcgaattgctttagcgcggatgacatctctagctctagctgtcaccgtattgttaacgacaatgcagagattttcttcagcaacgccctggtgtatcgccgtattgtcaagtctctgagcaacgacgacattaacaagatcagcggcgacatgaaagacagcctgaaagaaatgtctctggaagaaatctacagctacgagaaatatggtgagtttatcacccaagagggcattagcttctacaatgatatctgtggtaaggttaatagctttatgaatctgtactgccagaagaataaagaaaacaagaacttgtacaagctgcaaaagctgcataagcaaattctgtgcatcgccgatactagctatgaagttccgtacaagttcgagtctgatgaagaggtgtatcagtcagtcaacggttttctggataacatcagcagcaagcacatcgtcgagcgcctgcgcaagattggtgacaactacaatggttataacctggacaagatctatatcgtgtcgaagttttacgagagcgtgtcccagaaaacgtaccgtgattgggaaacgattaacacggccttggaaattcactataacaatatcctgccgggcaacggcaagagcaaagctgacaaagtcaaaaaagctgtgaaaaacgatctgcaaaagtccatcaccgagatcaacgaactggttagcaactataagctgtgtagcgacgacaacattaaagctgaaacgtatatccacgaaatcagccacatcctgaataactttgaggcacaagaactgaaatacaatcctgagatccatctggtagagagcgagctgaaggcaagcgagttgaaaaacgttctcgacgttatcatgaatgctttccactggtgtagcgtgtttatgaccgaagaactggttgacaaagataacaatttctatgcagagctggaagaaatctatgatgaaatctacccggtcatcagcctgtataacctggttcgtaactacgtgacgcagaagccgtacagcaccaaaaagatcaagctgaacttcggtattccgaccttggcggacggttggagcaaatccaaagaatactccaataatgcgattattctgatgcgtgataatctgtactatctgggtatcttcaatgcgaagaacaagccagataaaaagattattgaaggcaacaccagcgagaataaaggcgactacaagaaaatgatctacaacttattgccgggtccgaacaagatgatcccgaaagtttttctgagcagcaagaccggcgttgaaacctataagccgagcgcgtacattttagagggctataaacaaaacaagcacatcaagagcagcaaagattttgatattacgttctgccacgacctgatcgactatttcaagaattgtattgcgattcaccctgagtggaagaacttcggttttgacttttccgatacctccacctatgaagatattagcggtttttaccgtgaagtcgagttgcagggttataagattgattggacttacatttccgagaaagacatcgacctgttgcaagagaaaggtcagctgtacctgtttcagatctataacaaagatttcagcaaaaagtcgacgggcaatgataatctgcacaccatgtatctgaaaaacctgtttagcgaagagaacctgaaagacattgttcttaagctgaatggtgaggccgagatcttcttccgtaaaagctccattaagaacccgattatccacaaaaagggctctattctggttaaccgcacgtacgaagcggaagagaaagatcaatttggtaacatccagatcgtgcgtaagaatatcccggagaacatttaccaagaactgtataagtatttcaatgacaagagcgataaagaattgagcgatgaagcggcaaagctgaaaaacgtcgttggccaccacgaagccgcgacgaatatcgtgaaagattatcgttacacctacgacaagtactttctgcacatgccgatcaccatcaatttcaaagcgaataaaacgggttttatcaatgaccgtatcctgcagtacattgcgaaagaaaaagatttacacgtgattggtattgatcgcggcgagcgcaatctgatttacgtcagcgttatcgacacgtgcggcaatattgtggagcagaaaagcttcaatatcgtcaatggttacgactaccagatcaaactgaagcaacaagagggcgcccgccagattgcgcgtaaagagtggaaagaaatcggtaagattaaagaaatcaaggaaggctacctgtccctggtgatccatgaaatcagcaaaatggtgatcaagtacaacgctatcattgcgatggaagatctgagctacggttttaaaaagggtcgcttcaaagttgagcgtcaagtgtatcagaaatttgagactatgctgattaacaagttgaactatctggtttttaaagacatcagcattaccgagaatggtggcctgctgaagggttatcaactgacctatattcctgacaagttgaaaaatgttggtcatcagtgtggttgcattttctacgtaccggcagcgtacacgagcaagattgacccgaccacgggtttcgttaacattttcaagtttaaagatttgaccgtggacgccaagcgtgagttcattaaaaagttcgacagcatcagatacgactctgagaagaatctgttctgctttacgttcgactacaataacttcattacccaaaataccgttatgagcaaaagctcctggagcgtgtacacgtacggcgtccgtatcaagcgtcgttttgtgaatggtcgcttttccaacgaatctgacaccattgacattaccaaagatatggaaaagacccttgagatgaccgacattaattggcgtgatggccatgacttgcgccaagacattatcgactacgaaattgttcagcacatctttgagatttttcgtctgacggtccagatgcgcaactcgctgagcgagttggaagatcgtgactatgaccgtctgattagcccggtgctgaatgaaaacaatatcttctatgatagcgcaaaggccggtgacgcgctgccgaaagatgcggatgctaacggtgcatactgcattgcactgaagggtctgtacgaaatcaaacagatcaccgagaattggaaagaggatggtaagtttagccgtgataagctgaagattagcaataaagactggttcgactttattcaaaacaagcgctatctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 65 - DNA, 3963 bp, Artificial Sequence
  Description of Artificial Sequence: Synthetic polynucleotide
agcccagcggctaaaaaaaagaaactggatggcagcgtggatatgaacaacggaacaaataattttcagaactttattgggatcagttcgcttcagaaaacgcttcgtaatgctctgattcccacagaaaccactcagcagtttatcgtaaagaatggcattatcaaggaggatgaattacgcggcgagaaccgccaaatcttaaaagatatcatggacgactactaccgcggtttcattagcgaaactcttagttcaattgacgacattgactggacgtccttgttcgaaaagatggagattcaattaaagaacggtgataacaaggatacgttgattaaagaacagacggagtaccgtaaggctatccacaaaaaatttgcaaacgacgaccgctttaaaaatatgtttagcgcaaaattaatctccgacatcctgcctgaattcgtcatccataacaataactatagcgcctcggaaaaagaagaaaaaacgcaggttattaaacttttctcgcgctttgcaacaagctttaaggattacttcaaaaatcgcgccaattgtttttcagccgacgacattagctccagttcctgccaccgtattgtgaatgacaacgctgagatttttttttccaatgcgctggtttatcgtcgtattgttaagagccttagtaacgacgacattaataaaattagcggtgatatgaaggatagcttgaaagaaatgagtctggaagagatctatagttacgagaagtacggcgaatttattacccaggagggcatttcattttacaatgatatctgtggaaaagtcaactcctttatgaacttgtattgccaaaagaataaagaaaacaaaaacctgtacaaactgcaaaagttacacaagcagattttgtgtatcgcagacacgtcatacgaagtaccgtacaagtttgagtccgatgaagaagtgtaccaaagcgttaatggctttttggataacatttcgagcaaacatatcgtagagcgtttgcgtaagattggtgataattacaacggttacaatttagacaaaatctatatcgtctctaagttttacgaaagtgtttctcagaaaacttaccgcgattgggagacgatcaacactgcgctggagattcattacaataatatccttccaggtaacggtaaaagcaaagctgataaggtgaaaaaggcggttaaaaatgaccttcaaaagtctatcacagaaatcaacgaattggtcagcaattataagctttgcagtgacgataacattaaggccgagacttacatccatgagatctctcacattcttaataattttgaagcgcaagagctgaaatacaatcctgaaatccatctggtcgaaagtgaattaaaagcctccgaattaaaaaatgtcttggacgtgatcatgaatgcgttccattggtgctcagtttttatgacggaagagttggtggacaaagacaacaatttttacgccgagcttgaggaaatttacgacgaaatttaccccgttatttcgttatacaaccttgtgcgtaattacgttacacaaaagccctattcgacaaagaaaatcaagttaaatttcgggattcccacattagctgatggatggtccaaatccaaagaatactcgaataacgctatcatccttatgcgtgataatttgtactacttaggcatcttcaatgcgaagaacaaacctgacaagaaaattatcgaaggaaacacttcggagaacaaaggtgattataaaaagatgatctacaacttgcttcccgggccaaacaaaatgattcccaaggtatttttgagttctaaaaccggtgtcgaaacttacaaaccaagtgcttatattttggaaggatacaaacagaacaaacatatcaagtcttcgaaagacttcgatattacgttctgccacgatctgatcgattacttcaagaactgtattgctattcaccccgagtggaagaactttggatttgatttctccgacacgtccacttatgaagatatctctggcttctatcgcgaggttgaattacaagggtataagattgactggacttatatttcggagaaggatatcgatcttttgcaagaaaaagggcaactttatttatttcagatctataacaaggacttttcaaaaaagagcactggaaatgacaatctgcataccatgtaccttaagaacctgttctcggaagagaacctgaaggacattgtacttaaactgaatggagaggcagagatcttctttcgcaaatcaagcattaagaacccaattattcacaaaaaggggagtatcttagtaaatcgcacatatgaggctgaggaaaaagatcagtttggtaacattcagatcgtgcgtaagaacattcctgaaaatatctatcaggaactttataagtatttcaacgataaaagtgataaagagctgagtgacgaagcggctaaacttaagaatgttgtgggacaccatgaggcagcaaccaatattgtgaaggattatcgctatacgtacgacaaatactttttacacatgcccatcactattaattttaaagctaataagactggcttcattaacgatcgcatcctgcagtacattgctaaggaaaaggatcttcacgttatcggtatcgatcgcggggagcgtaatcttatctacgtctctgtcattgacacgtgtggcaatattgtggagcaaaagtccttcaatattgttaacggctatgactatcagattaaattgaaacagcaggaaggtgcgcgtcagattgcccgcaaggaatggaaggaaattggcaagatcaaagaaattaaggagggctacttaagcttagtaattcacgaaattagtaaaatggttatcaaatacaacgccatcatcgcgatggaggatctttcgtacgggtttaagaaaggtcgttttaaagtggagcgtcaggtgtaccagaaatttgaaactatgcttattaacaaacttaactacctggttttcaaggatatcagtattactgaaaacggggggctgttaaaagggtatcaattaacttacattccagacaaattaaagaacgttggacatcagtgtggctgcattttttatgtaccagctgcatacacttcaaagatcgatcctacgactgggttcgtgaacatttttaagtttaaagacttgacggtagatgccaagcgcgaattcatcaagaaattcgacagcattcgctacgactctgagaaaaatcttttctgtttcacattcgattataacaatttcattacgcagaacacagtaatgtccaagtcttcttggagtgtttatacatatggtgtccgcattaagcgccgtttcgtcaacggccgcttcagtaatgagagcgatactattgacatcacaaaagacatggaaaaaacactggaaatgaccgacatcaattggcgtgacggccatgacttacgtcaggatatcattgattatgagatcgttcaacacatcttcgaaatctttcgcttgactgttcaaatgcgcaattccttgtcggaattggaggaccgtgattatgaccgcttaatttcccccgtcttaaatgaaaacaatattttttatgactctgcaaaagctggagatgctctgccgaaagacgccgatgcaaatggggcatattgcattgctttaaaggggctttacgagatcaagcaaatcaccgaaaactggaaagaggatggaaagttttcgcgtgataaactgaagatctctaacaaagactggttcgactttatccagaacaagcgttatttgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 66 - DNA, 3963 bp, Artificial Sequence
  Description of Artificial Sequence: Synthetic polynucleotide
agcccagcggctaaaaaaaagaaactggatggcagcgtggatatgaacaacggcaccaataacttccaaaacttcatcgggatctctagccttcagaagacgcttcgcaatgctcttatcccaactgagaccactcaacaatttattgtgaagaatggaattattaaagaggacgaactgcgtggcgagaatcgtcagatcttaaaggacattatggatgattattaccgtggattcatctccgaaacattatcgtcgatcgatgatatcgattggacttctctgttcgagaaaatggaaattcaattgaaaaacggagataataaagatacgcttatcaaagaacagacggaatatcgtaaagcgattcataagaaattcgcaaatgacgatcgtttcaaaaatatgttcagtgccaagcttatttcggacattttacctgaatttgtaattcataataataactactcagcaagtgagaaggaggagaaaacccaagttattaaactgttctctcgtttcgcaacgtcctttaaagattactttaaaaaccgcgcgaattgctttagcgctgacgacatttccagctcatcctgtcatcgcatcgtaaacgacaatgcggaaatcttcttcagcaacgccctggtttaccgccgcatcgtcaaaagcttatcgaatgacgacatcaataagatctcaggagatatgaaggactcgcttaaggagatgtctctggaggaaatttatagttacgaaaagtatggagagttcattacccaggagggaatctcgttctacaatgacatttgcgggaaggtgaactccttcatgaacttatactgccagaaaaacaaagagaacaaaaatctgtataaattgcagaaattacataaacagattctttgtattgctgacacttcctacgaagtaccctataaattcgagtcagatgaagaagtataccagtccgtgaacggatttctggacaatatctcctcaaaacacatcgtggaacgcttacgtaaaattggcgataattataatggttacaatcttgacaaaatttatatcgtatctaaattttacgagagtgtgagccaaaagacctaccgcgactgggagaccatcaacacagctttagaaattcactataataatatcttacccggcaatggtaagagcaaggctgacaaggtaaaaaaggccgtcaagaatgatttgcagaaatctattacagaaattaatgagttagtctccaactataagctttgttccgacgataacatcaaagctgagacatatattcatgagattagtcacattcttaacaacttcgaggcccaggaacttaagtacaatcctgaaattcatcttgtcgagtctgagctgaaagctagtgaattgaaaaatgttttagacgttattatgaacgcattccactggtgctctgtgtttatgacagaagaactggtcgacaaggacaataacttctatgccgaacttgaggaaatctacgatgaaatttaccctgtaatctccttgtataatcttgtacgtaattacgtcactcaaaaaccttacagcacgaaaaaaattaaattgaacttcgggattcctacacttgccgacgggtggtctaaatccaaggaatatagcaacaatgccattattttaatgcgcgacaatctttactatttaggaatttttaacgctaagaacaagcccgataaaaagattattgaaggaaacacgtctgaaaataagggcgactacaaaaagatgatttataaccttttgcccggtccaaacaaaatgatcccaaaggtattcctgtcatccaaaacaggggttgagacatataagcccagcgcatatattctggaaggatacaaacagaataaacatatcaaaagcagcaaagattttgacattactttttgccacgatttaatcgactacttcaaaaactgtatcgctatccaccctgaatggaagaatttcggatttgatttctcagatacaagtacgtatgaggatatcagcggtttctatcgcgaagttgaacttcaagggtataaaattgactggacctacattagtgagaaggacatcgacctgttacaggaaaaaggccaattgtacttgtttcagatctacaataaggatttctcaaaaaaatcgaccggcaatgataacttgcacaccatgtacctgaagaaccttttttcggaggaaaaccttaaagacattgtcctgaagttgaatggagaagcggagattttctttcgtaagtcttccattaaaaatccaattattcataagaagggcagcatccttgtgaaccgtacgtacgaggcggaagagaaggaccaattcggtaacattcaaatcgtccgcaagaacatccctgaaaatatttatcaggagctttacaagtatttcaatgataagtccgacaaggaattatcagatgaggctgcgaagttgaaaaatgttgttggtcatcacgaggcggcgacgaatattgtaaaggattatcgctacacttatgacaagtactttctgcacatgccgatcaccattaatttcaaggcgaacaaaacaggatttattaatgaccgcatcttacaatacattgccaaagaaaaggacttacacgttattggcattgatcgtggagaacgcaacttaatctacgtaagcgttattgacacttgcgggaatatcgtagaacaaaagagcttcaacatcgtgaatggttacgattaccagatcaagcttaagcagcaggagggagcgcgccagatcgcgcgcaaggaatggaaggagattggtaagatcaaggaaatcaaggaaggttatctgtccttggtaatccacgaaatttcgaaaatggttatcaaatacaatgctattattgcaatggaggacttgtcctacggctttaaaaaaggacgctttaaggtggagcgccaggtttatcaaaagtttgaaacaatgctgattaacaagctgaactatttggtctttaaagatatctccatcaccgaaaatggtgggcttttgaaaggctatcaacttacatatatccctgataagcttaagaatgtgggtcatcagtgcgggtgcattttttatgttcctgcagcctacacgtccaaaatcgatcctacaactggatttgttaatatcttcaaatttaaggatcttaccgtcgacgcgaagcgcgaatttatcaagaaattcgatagtattcgttatgattccgaaaaaaaccttttctgtttcacctttgattataataactttatcacgcaaaatactgtcatgagcaaatcgagttggtctgtgtacacttacggagtacgcatcaagcgtcgttttgttaatgggcgcttcagtaacgagtcagacacgattgatatcacaaaagatatggagaaaacgctggagatgacagacatcaattggcgcgatggtcatgacttacgtcaagacattatcgattatgaaattgtccagcatatctttgagatctttcgtttgactgttcagatgcgcaacagcctgtcagaattggaggatcgtgactatgatcgccttatttctcccgtcttaaatgagaacaatatcttctacgactcagccaaggctggagatgcactgccaaaagacgccgacgcaaatggggcctactgtattgcattgaaggggttgtacgagatcaaacagattacagaaaattggaaggaggacggtaagttctctcgtgataagctgaagatttctaacaaagactggttcgatttcattcagaacaaacgttacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 67 - DNA, 3963 bp, Artificial Sequence
  Description of Artificial Sequence: Synthetic polynucleotide
agcccagcggctaaaaaaaagaaactggatggcagcgtggatatgaacaacggtaccaataactttcagaatttcattggaatcagcagcttacagaaaaccctgcgcaatgcacttatccccactgagacaacccagcagttcattgtaaagaacgggattattaaagaagatgagcttcgcggggagaatcgtcagatcttaaaggatattatggacgattactaccgtggcttcatttcggagacgctgtcgtcgatcgacgacatcgactggacatccttgtttgaaaagatggaaatccaactgaagaatggcgataacaaggacacgttaatcaaagagcagacggaataccgtaaagctatccacaaaaagttcgctaatgacgaccgctttaagaacatgttctcagcaaaacttattagcgatattttacctgaatttgtcatccacaataacaattactccgcgagtgaaaaagaggagaaaacccaggtgattaagctgttttcccgttttgcaaccagtttcaaggactattttaagaatcgtgctaattgtttctctgcagacgacatttcctcgtcgtcctgccatcgcattgttaatgataatgctgaaatctttttttcaaacgcacttgtgtatcgtcgcattgtcaaaagcttaagtaatgacgatatcaataagatctcaggagacatgaaggactccctgaaagaaatgtcattggaagaaatttactcttatgaaaagtatggagaatttattacgcaggagggtatcagcttctataacgacatttgtggtaaagtgaacagctttatgaatctttattgtcaaaagaataaagagaacaaaaatctgtacaagctgcagaaattgcataaacaaattctgtgcattgcagatacttcgtatgaggttccttacaaattcgagtcggatgaggaggtgtatcaaagcgtaaacggatttttggataacattagtagtaagcatattgtggaacgccttcgcaagattggtgacaactataacggatacaacttagacaagatctatattgtctcgaagttttacgaaagtgtttcccaaaagacttatcgcgactgggagacaatcaacactgcgctggaaattcactataacaatatcttgccggggaacggaaaaagtaaggcagataaggtgaagaaagcagtcaaaaatgatctgcaaaaaagcattactgaaattaacgaacttgtgtcaaattacaaattgtgttcggatgacaatattaaagcggaaacgtatatccacgagatctcgcacattcttaataatttcgaggcgcaggaattaaagtataatcctgagatccatttggtggaatcagaacttaaagctagtgaactgaaaaatgtcctggacgttattatgaatgcatttcactggtgttctgtctttatgacagaagaacttgtcgacaaagacaacaacttttatgcggaattagaagagatttacgacgaaatttatcccgttatttcgttatataatttagttcgtaattacgtgactcagaaaccctacagcacaaaaaagattaaattaaactttgggattccgactcttgctgatggatggagcaagtccaaggagtactctaataacgccattatcttgatgcgtgacaacctgtactacctgggcatttttaacgctaaaaacaaacccgacaaaaagatcattgaagggaacacctcggaaaataagggggactataaaaaaatgatctacaatctgttgccaggcccaaataagatgatcccaaaggtttttttatcttccaaaactggcgtagaaacttacaagccgagcgcatacatccttgaaggatataaacaaaacaaacatatcaaaagttcaaaggacttcgatattacgttctgccatgatttaatcgattatttcaagaattgcatcgcgattcacccagagtggaaaaactttgggtttgatttttcagacaccagcacttacgaggatattagtggattctatcgtgaggttgaactgcagggctataaaattgactggacctatatttctgaaaaagatattgatctgcttcaggagaaaggccaattgtacttatttcaaatctataacaaggatttctccaagaagtccacgggtaatgacaacttacacacaatgtatctgaagaatctgtttagtgaggagaacttgaaggacattgtgctgaagcttaatggcgaggccgaaatcttttttcgtaagtcctccattaaaaaccctattatccataagaaagggagtattcttgtcaaccgcacgtatgaggccgaagaaaaggaccaattcggaaacatccaaattgtccgtaaaaatattcctgagaacatttaccaggagctttacaagtatttcaacgacaagagtgataaagaactttcagatgaggcggcgaaactgaagaatgtagtggggcaccacgaagctgccacgaatattgtaaaggattaccgttacacctacgacaagtactttttgcatatgcccatcacaattaattttaaggccaataaaactggttttatcaacgatcgtatcttacagtacattgctaaggaaaaagatctgcacgttatcggtatcgatcgcggggaacgcaatctgatttatgttagtgtgattgacacgtgcggaaatattgttgagcagaagagctttaatatcgtaaatggatatgactatcaaattaaactgaagcaacaggaaggggcccgccagattgcccgcaaggagtggaaagaaattggaaagatcaaggagattaaagaagggtacctttcccttgttatccacgaaatctcgaaaatggtgatcaagtacaatgccattattgctatggaggatctgtcatatgggtttaagaaaggccgctttaaggtggaacgtcaggtttaccagaagtttgagaccatgcttatcaataagctgaattatcttgtcttcaaagacatctcaatcacagagaacggcgggctgttaaaaggatatcagctgacctatatccccgacaaactgaaaaatgtcgggcaccaatgcggctgtattttctacgtgcccgctgcatacacatctaaaattgacccaacgactggattcgtaaatatttttaagtttaaggatcttacggtagatgcaaagcgcgaatttatcaagaaatttgatagtatccgttacgacagcgagaaaaacttattttgttttacgttcgattataacaacttcatcacgcaaaataccgtcatgtcaaaatcttcctggtcagtctatacgtatggcgtccgtatcaagcgccgcttcgtcaacgggcgtttttcaaacgagtcagataccatcgatatcaccaaagatatggaaaaaacattggagatgacggacatcaattggcgcgatggtcatgacttacgccaggacattattgactacgaaatcgtacaacatatttttgagattttccgtctgaccgtgcaaatgcgcaactcattatccgaacttgaggatcgtgattacgaccgcttgatcagtcctgttctgaacgagaataatattttttacgacagtgccaaggcgggagacgcactgcccaaggacgctgacgctaacggagcttattgtattgcgttgaagggactttacgaaatcaagcaaatcactgaaaactggaaggaggatggtaaattctcacgcgacaagttgaaaatttcgaacaaggactggttcgatttcatccaaaacaagcgttatttaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 68 - DNA, 3963 bp, Artificial Sequence
  Description of Artificial Sequence: Synthetic polynucleotide
agcccagcggctaaaaaaaagaaactggatggcagcgtggatatgaacaacgggactaataacttccagaacttcatcggtatttcatcattacaaaaaacgcttcgtaacgccttgatcccaacagaaacgacccaacaatttattgtaaaaaacggcatcatcaaagaagacgaactgcgtggcgaaaatcgccaaattttgaaggacattatggatgactattatcgtgggtttatctcggagacattatcctccatcgacgacattgattggacgagtctttttgagaaaatggagatccagcttaaaaatggtgataacaaggatacattgatcaaggagcaaaccgagtaccgcaaggccatccataagaagttcgcaaatgacgaccgcttcaaaaatatgtttagtgccaaattgatctcggatatccttcctgagttcgtaattcacaacaataattatagcgcatccgaaaaggaggaaaagactcaagtcattaagcttttcagtcgctttgctacctcgtttaaggactatttcaagaaccgcgcgaactgcttctcagcggatgacatttcttcctcgtcgtgtcaccgcatcgtgaatgataatgcggagatcttctttagtaatgccttggtataccgccgcattgttaaatccctgtctaacgacgatatcaataagatctcaggagatatgaaggatagccttaaagaaatgtctctggaagaaatttactcctatgaaaagtacggtgagtttatcacccaagaggggattagcttttataacgatatctgcgggaaggtgaattcgtttatgaacctttattgtcaaaagaataaggagaataagaacttatataagcttcagaaactgcataaacaaatcttatgcattgccgatactagctatgaagttccgtataaattcgagagcgatgaagaagtttatcagagcgtcaatgggttcttggataacatttcatcaaaacacatcgtggaacgtctgcgtaagattggggataactacaacggatataatcttgacaaaatttatattgtatctaaattctatgagtcggtgagtcaaaagacctaccgtgattgggaaacaatcaataccgcgttagaaatccactataacaacattctgccagggaatggtaaaagtaaagcggacaaagtcaagaaggctgtgaagaacgatctgcaaaagagtattacagagattaacgaattagtctccaattataagttatgctcggacgataacattaaggcggagacgtatattcatgagatttcgcatattcttaacaacttcgaggcacaagagcttaagtataacccagagattcaccttgtcgaatcggagctgaaggcatcggaattaaaaaatgtcttagatgtaatcatgaacgcgttccattggtgcagtgttttcatgactgaggagttagttgacaaggacaataacttctacgcagaattagaagagatctatgatgagatttatccagtgatttcgctgtataatctggtacgtaattacgtcactcaaaagccctactcaacaaaaaaaattaagctgaacttcggaattccgactctggccgacgggtggtccaagtcaaaggagtattctaataatgctatcatcctgatgcgcgataacttatactatttgggaattttcaatgccaaaaataaaccagataaaaagattatcgaaggtaatacaagcgagaataagggtgactataagaaaatgatttacaatcttcttccaggccctaacaagatgattcccaaagtttttttgtccagtaaaacaggggtcgaaacttacaagcccagtgcctatatccttgaagggtacaagcagaataagcacatcaaatcctcgaaagactttgatattacattttgtcatgacttaatcgattattttaagaactgtatcgcaatccatccagaatggaagaacttcgggtttgatttctctgatacttccacgtatgaggatatttccgggttctaccgcgaagtagagcttcagggctataaaattgactggacatatatttcagaaaaagacatcgatctgttacaagaaaaaggacagttgtatctgtttcaaatctataataaggatttctccaaaaagtcaactggaaatgataacttacatacaatgtatctgaaaaatctttttagtgaagagaatttgaaggatatcgtgctgaagttaaatggcgaagcagagatcttcttccgcaagtcctcgatcaagaatcctatcatccacaagaaaggtagtattctggttaaccgcacgtacgaggccgaggaaaaagaccagttcggtaatatccagattgtacgtaagaatattcctgaaaatatttaccaggaattatacaagtattttaacgacaaatcggataaggagctttcagatgaggccgcaaagttgaagaacgtcgtaggacaccatgaggccgctacgaatatcgtcaaggactaccgctatacgtatgacaagtacttcctgcacatgcctattactatcaatttcaaagctaataaaacaggattcatcaatgatcgtatccttcagtacattgccaaagaaaaagatctgcacgtaatcggaatcgaccgtggcgaacgtaatctgatttacgtatcagttatcgacacatgtggtaacatcgtggagcagaaatcttttaacattgttaacggctatgattatcagattaagcttaaacagcaggagggggcacgccaaatcgctcgtaaagaatggaaggagattggaaagattaaagagattaaagaggggtacctttcgctggttattcacgaaatttccaagatggtgattaagtacaatgcaatcatcgcgatggaagatcttagttacggattcaaaaagggacgcttcaaagttgagcgtcaggtctaccagaaatttgaaacgatgctgattaacaaattgaattacttggtattcaaagatatctcaattactgaaaatggtggcttattaaagggttaccagcttacctatatcccggataagctgaagaacgtgggccatcaatgcggctgcatcttttacgtccctgccgcatatacctctaaaattgaccccaccaccggattcgtaaatatttttaaattcaaggacctgacggtggacgccaagcgcgaattcatcaaaaaattcgactcaatccgctatgattccgaaaaaaatcttttctgctttacgttcgattataataacttcattacccaaaacacggtgatgtcaaaatcgtcctggagcgtgtatacttatggagtgcgtatcaagcgccgctttgttaatgggcgcttcagtaacgaaagcgataccatcgacattaccaaagacatggagaagacgcttgaaatgacggatatcaattggcgtgacggacacgatcttcgtcaggatatcatcgactacgagattgtgcaacatatctttgagattttccgtttaactgttcaaatgcgtaactccttgtccgaattggaagaccgtgattacgaccgcttgatttcaccagtgcttaacgagaataacatcttctacgactccgccaaagcaggcgatgccctgccaaaggacgctgatgcaaatggtgcatactgtatcgcgttgaagggcttatacgagattaagcaaatcaccgaaaattggaaagaggatggaaagttcagtcgcgataagctgaagatctctaataaagattggtttgactttatccagaacaaacgttatttaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 69 - DNA, 3963 bp, Artificial Sequence
  Description of Artificial Sequence: Synthetic polynucleotide
agcccagcggctaaaaaaaagaaactggatggcagcgtggatatgaacaacggtaccaataatttccaaaatttcatcggaatctcatccttgcaaaaaaccttgcgcaatgctttgatccccaccgaaaccacgcagcagttcatcgtgaaaaacggcattatcaaagaggatgagttgcgcggggaaaaccgtcaaattcttaaggatatcatggacgattactaccgtgggtttatcagtgagaccctgtcaagcattgacgacattgactggaccagcttatttgagaagatggagattcaattaaagaacggggacaataaggacacgcttatcaaagagcagacagaataccgtaaagcgattcataagaaatttgcaaatgacgatcgcttcaagaacatgttttcagcaaaattaatcagcgacatccttcccgaatttgtgattcataataacaactattcggctagcgaaaaagaggagaaaactcaggttattaagcttttctcgcgttttgccacttcgttcaaagactattttaagaatcgcgcaaactgcttttcggctgatgatatttccagttctagctgccatcgtatcgttaacgataatgctgagattttcttctctaatgccctggtgtatcgtcgtatcgttaaatctttgagcaacgacgatattaataagatttcaggcgacatgaaggattctttaaaggagatgtctttagaagagatttattcctatgagaaatatggcgagtttatcacccaagaaggaatttcgttctacaacgacatctgtggcaaagtgaacagcttcatgaatttatactgccaaaagaataaggagaataaaaatttatataaactgcagaaactgcataagcaaattctttgcattgcagacacctcttatgaagttccttataagtttgaatcggacgaggaggtatatcagagtgtgaacgggttcctggacaatatttcatccaagcatattgttgaacgtttacgcaaaattggagacaattacaatgggtataaccttgacaaaatttacatcgtgtcgaagttttacgaatcggtaagccagaagacctatcgtgactgggaaactatcaataccgccttagaaattcattacaacaatattcttcctggtaacggcaaaagcaaagccgataaggtaaagaaggctgtcaagaacgacctgcaaaagtctatcacagagatcaacgagttagtctctaactacaaattatgttccgacgacaatattaaagccgaaacctacatccatgagatctcacacattcttaacaattttgaggcccaggagctgaaatataacccagaaattcaccttgtagagagcgaattaaaagcctccgagctgaagaacgttttggatgtaatcatgaacgcatttcattggtgcagcgtatttatgacagaggagttggtcgacaaggacaataacttttacgccgagcttgaagaaatctacgatgaaatttacccggtaattagtttatataatttagttcgcaactacgtaactcagaaaccctacagtaccaagaagattaaattgaactttgggatcccgacacttgctgacggttggagtaaatcaaaagaatactccaataatgcaattatcctgatgcgcgacaatctttactacttggggatctttaacgcaaagaacaaaccagataagaaaatcatcgagggcaacaccagcgagaataaaggcgattacaagaaaatgatctataatcttttgccgggaccgaacaaaatgatcccaaaggttttcctgtcgtcgaaaacgggagtcgagacatataaaccatctgcgtacatcttggaaggttacaaacagaataagcatattaagtctagtaaagacttcgacatcaccttttgtcatgacctgattgattatttcaagaactgtattgctatccatccagaatggaaaaacttcggatttgacttctccgatactagcacctacgaagacatttcgggtttttatcgcgaagtagagcttcaagggtacaaaattgattggacatatattagcgagaaagacattgatttgcttcaagagaagggacagttatatttattccagatctacaacaaagacttctcgaagaaatccaccggtaatgataatcttcacactatgtacctgaagaatttattttcagaggaaaatctgaaggacattgtacttaaacttaatggagaagccgaaatcttcttccgcaagagttccattaaaaatccgattattcataaaaagggaagtatccttgtgaaccgcacgtatgaggccgaagagaaggatcagtttgggaatattcaaattgtccgcaaaaacatccccgagaacatctaccaggaactgtataaatactttaatgataaatctgataaagagttatcagacgaggctgccaaactgaaaaacgtagtcggtcatcatgaggcagcgaccaatattgtaaaggactaccgttacacctacgacaagtatttccttcacatgccgatcacgattaattttaaggctaacaagaccggctttatcaatgaccgcatcttgcagtacatcgcgaaagagaaagatttacacgtcatcggaattgatcgtggagagcgtaatcttatctacgtcagcgtcatcgacacctgtggaaacattgtggaacaaaaaagttttaatatcgtaaacggctacgactatcaaattaaacttaaacagcaagagggagctcgccagatcgctcgcaaagagtggaaagagattgggaaaattaaagaaattaaagagggttacctgtcgctggtaattcacgaaatctcgaaaatggtcatcaaatataatgcaattatcgctatggaggatctgtcctacgggttcaagaagggacgttttaaagtagagcgccaggtgtatcaaaaattcgaaaccatgttgatcaataagcttaactatttggtcttcaaagatatttcgattacggagaacggaggtttgttgaaaggatatcagctgacgtatatcccagacaagttgaaaaacgtggggcatcaatgtggatgtattttctatgtgcccgcggcctacacgagtaagatcgatcctaccactggtttcgtcaacattttcaaatttaaagatcttaccgtggatgcgaagcgcgaatttattaagaaatttgatagcattcgctatgattccgaaaagaacctgttctgttttacgttcgactataacaatttcattacccaaaacacggtgatgagcaaatcctcttggtcagtttatacatacggtgtacgtatcaaacgccgtttcgttaacggacgcttttccaatgagtctgatacaatcgatatcacgaaagatatggaaaaaacattagagatgactgatatcaactggcgtgacgggcacgacctgcgtcaagacattattgactacgagattgtgcagcatatcttcgaaatctttcgcttaactgtgcaaatgcgtaactcgttatccgagttagaagaccgtgactacgatcgcctgatttcacccgtcttgaacgaaaataacatcttctacgattccgcgaaggctggggacgcattgcccaaggacgcagacgcgaatggagcgtactgtattgcgcttaaaggattatatgaaatcaagcagatcaccgaaaattggaaggaggacgggaagttctcacgcgacaaactgaagatttcaaataaggactggttcgatttcattcagaataagcgttacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 70 - DNA, 3963 bp, Artificial Sequence
  Description of Artificial Sequence: Synthetic polynucleotide
agcccagcggctaaaaaaaagaaactggatggcagcgtggatatgaataatggtacgaacaactttcagaacttcatcggcatctccagccttcaaaagactttacgcaacgcattgattcccacggagactacgcaacagtttatcgtaaaaaatggtattatcaaagaagatgaattacgcggggagaatcgccagattcttaaggacattatggacgattattaccgtggattcatcagtgagacactgagctccattgatgacatcgactggacgtcattgtttgaaaagatggaaatccagttgaaaaatggcgataacaaagatacattgattaaagagcagacagagtaccgcaaagcaattcacaagaaattcgccaatgatgatcgttttaagaacatgtttagtgccaagcttatttcggatatcttacccgaattcgtgattcacaacaacaattattcggcaagtgagaaagaggaaaagacccaggttatcaaattgttttcgcgcttcgccacttcgttcaaagattatttcaagaaccgtgcaaactgtttctccgctgacgacatcagttccagctcatgccaccgtattgtaaatgacaatgcggagatctttttcagtaatgccttagtatatcgtcgcattgtaaagagcttatctaatgatgacattaacaagatctcgggtgatatgaaggactcacttaaggagatgagtctggaagagatctactcctacgaaaaatacggggaattcatcacccaggagggaatttcattctacaacgatatctgcggcaaagttaactcctttatgaatctgtactgtcaaaagaacaaggagaataaaaacctgtataaattgcagaaacttcataaacaaattttgtgtatcgcagacacgagttatgaagtaccttataaattcgaatccgacgaagaggtatatcagtccgtaaatgggttcctggacaatatcagtagtaagcacattgtggaacgcttacgcaaaattggagacaattacaacgggtataacctggacaaaatctacatcgtatccaaattttatgaaagcgtgtctcaaaaaacttatcgtgattgggaaacaatcaacacggctcttgagatccattacaataacatcttgccgggtaacggcaaatcgaaggcagacaaagttaaaaaagcagttaagaacgacttacagaaaagcattacggagattaacgagttagtaagtaattacaaattatgctccgacgataatatcaaagctgaaacctacatccatgaaattagccacattttgaacaatttcgaagcgcaggagctgaaatataaccctgaaatccatctggtagagtctgagttgaaggcgtcagaactgaaaaacgttcttgacgtcatcatgaatgcctttcactggtgtagtgtttttatgactgaggagcttgtagataaggacaacaacttctatgctgaacttgaagagatctacgatgaaatctaccccgtaatcagtctgtataatttagttcgtaactacgtcacgcagaaaccctattcgactaagaaaattaagctgaactttgggatccctactttggcagacgggtggagcaagagtaaagaatacagtaataatgcaattatcttgatgcgcgataacttatattacttaggtattttcaatgctaagaacaaacctgataagaagattatcgaaggaaatacgagtgagaataagggagactacaaaaagatgatttacaacttgctgccagggcctaataagatgattccaaaagtttttctgtcgagcaagacaggggttgaaacttataagccatccgcttatatccttgaggggtacaagcagaataagcatatcaagtcctccaaagattttgatattacattttgccacgacttaattgattacttcaagaactgcatcgcaatccatcccgaatggaagaatttcggcttcgatttctcagatacgtccacgtatgaggatatctcaggcttttaccgcgaagttgagctgcaaggttataaaattgattggacatacatctccgaaaaagacattgatcttttacaggaaaagggccaattatacttatttcaaatctataacaaagattttagcaagaagtccacaggtaatgataacctgcatacgatgtatttgaaaaatcttttcagtgaagagaatttgaaggatatcgtcctgaagctgaacggtgaggctgagatcttcttccgcaaatcgtctatcaaaaaccccatcattcacaaaaagggaagtatcttagtaaaccgcacttatgaagcggaggaaaaggatcagttcgggaacatccagatcgtgcgcaagaacattccagaaaacatctatcaggaactttacaaatatttcaatgacaagtctgataaagaattatcagacgaggcggcgaaacttaaaaatgttgttggacaccacgaagcagcgacgaatattgtaaaggattatcgctacacatacgataaatactttttgcacatgccaatcaccattaactttaaggcgaacaagacaggtttcattaacgaccgtattctgcaatatatcgcaaaggaaaaagacctgcacgttattgggatcgatcgtggcgaacgcaatttgatctacgtaagcgttatcgacacttgcggaaatatcgttgaacaaaaaagctttaatatcgtcaatggatacgattaccaaatcaagctgaaacaacaagaaggggcacgtcagatcgctcgtaaagaatggaaagagattggtaagatcaaagagattaaagaagggtatctttctttagtaattcacgagatttcgaaaatggttattaaatacaatgcgattattgctatggaagacttaagctacggctttaagaaaggtcgcttcaaagtggagcgccaagtgtatcagaagtttgaaacgatgttgattaacaaattaaattacctggtctttaaggacatcagtatcacagaaaatggggggttgcttaaagggtaccagcttacatacatccctgataaactgaaaaatgtcggtcatcagtgcggatgtatcttctatgtaccagcagcctataccagtaagattgaccctactactggctttgtgaatatttttaaattcaaggatttaaccgtggacgccaagcgtgaatttattaaaaaatttgattcgattcgctacgacagtgagaaaaaccttttctgctttacctttgactacaacaattttattacccagaacaccgtaatgtcaaagagttcgtggtctgtatatacctacggtgttcgcatcaagcgccgcttcgtaaacgggcgtttcagtaacgaatctgacaccatcgacatcactaaagatatggagaagacattggaaatgacggacattaattggcgtgatggccatgacttacgtcaggacattattgattacgaaattgtgcagcatatcttcgagattttccgtttgacagttcagatgcgcaactcactgagtgagttagaagatcgcgattacgaccgtctgatctcaccggtccttaatgaaaacaacattttctacgactcagcaaaggcgggtgatgccctgccaaaggatgcggacgctaatggcgcctactgcatcgccctgaaaggattgtatgaaattaagcagattacagaaaattggaaggaagatggtaaatttagccgtgataaattaaaaatctcgaacaaggattggttcgattttattcagaacaaacgttatttgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 71 - DNA, 3963 bp, Artificial Sequence
  Description of Artificial Sequence: Synthetic polynucleotide
agcccagcggctaaaaaaaagaaactggatggcagcgtggatatgaacaatggaacaaataattttcaaaattttatcggcatctcaagtcttcaaaaaacccttcgcaatgccctgattccaactgaaacaacccagcaatttatcgtcaagaacggcatcattaaggaagacgagttacgcggggagaaccgtcaaatcctgaaagatatcatggatgactactatcgtgggttcatttcggaaaccttgtcttcaatcgacgacattgactggacgagtcttttcgagaaaatggaaattcagcttaaaaatggagacaacaaggatactctgattaaggaacagacagaatatcgcaaagctatccacaaaaagttcgctaatgatgatcgtttcaaaaatatgttttctgctaaattgatttccgatatcttgcctgaatttgtaatccacaacaacaattattctgcttccgagaaggaagagaagacccaggtcattaaattattcagccgctttgcaaccagctttaaagactactttaagaatcgcgctaactgcttttcggcggatgacatctcatcatcatcatgccaccgcattgtgaacgacaatgcggagatcttcttttcgaatgcgttagtttatcgtcgcattgtcaaaagtcttagcaatgatgacatcaacaagatctcaggagacatgaaagattccttaaaggagatgtctcttgaggaaatctattcgtatgagaaatacggcgagttcattacccaggaaggtattagtttctacaatgatatctgcggcaaagtaaattcttttatgaatctgtattgccaaaaaaacaaagaaaacaagaatctttataagttacaaaagttacataagcaaattctgtgcatcgctgatacatcttatgaggtaccctacaaatttgaaagtgatgaggaggtctatcagagtgtcaacggcttcttagacaacatctcttccaaacatatcgtggaacgcctgcgtaaaatcggagataactacaacggatataacttagataaaatctacatcgtgtccaagttttatgaaagtgtgagccaaaaaacatatcgtgactgggaaaccattaacaccgcattggaaattcactataacaacattttgccaggcaacgggaaaagtaaggcggacaaagttaagaaagcagttaaaaatgacctgcaaaaaagcatcactgaaattaacgaattggtatcgaattacaaattatgtagcgacgataatatcaaagcagaaacttacattcacgagattagtcacattttaaataacttcgaggcccaggaattgaaatacaatcccgaaattcatttggttgaatcagaactgaaagcatcagagttgaaaaatgtgttagatgtcattatgaatgcgtttcattggtgctctgtgttcatgaccgaggaactggttgataaagataacaacttttacgctgaattggaggagatttacgatgagatttacccggtcatttcgctttataacttagtgcgcaattatgtgacgcagaaaccatattccacgaagaaaatcaaacttaattttggcatccctactctggctgatggttggtcgaaatcgaaagagtacagcaacaacgcgatcattcttatgcgtgacaatctttactatttgggcatttttaatgccaagaataagccagataagaaaatcattgaggggaatacttccgagaataagggggattacaaaaagatgatctataacttgctgcccggccccaacaaaatgattcctaaggttttcttgtcaagcaagacgggcgtcgaaacatataagccgtcagcttatattctggaaggctataaacagaataagcacatcaagtcttccaaggactttgacatcactttttgccacgatttgatcgactactttaagaactgtattgcgattcatccggaatggaagaacttcggtttcgacttttccgatacctcaacatacgaggatatcagcggcttctaccgtgaagtcgagcttcaaggctacaagatcgattggacatatatttcagagaaggacattgatttgttacaagagaaaggtcaactttacttatttcagatctataacaaagacttttcgaagaaatcgacaggaaacgataacttacacactatgtatttaaaaaatctgttttcggaggaaaacctgaaagatattgtgctgaaacttaacggcgaggcagagatctttttccgtaaaagctcaatcaagaatcctatcatccataaaaaaggtagtattcttgtcaaccgcacatatgaagcggaggagaaggaccaattcggaaacatccaaattgtccgtaagaatattccggagaacatttaccaagagttgtataaatactttaacgataagtcagataaggaacttagcgatgaggcggcgaagcttaaaaacgtagttgggcatcatgaagctgctaccaacattgtaaaagattaccgttacacctatgacaagtatttcttgcacatgcccattacgatcaatttcaaagcaaataagacaggctttatcaatgatcgcatcctgcagtacattgctaaagagaaggatttgcatgttatcggtattgatcgcggagagcgcaatttgatctacgtctccgtaatcgacacttgcggtaacattgttgagcagaagtcgttcaacatcgttaatggttatgattaccaaatcaagctgaagcagcaagagggtgcccgccagatcgcgcgtaaggaatggaaagaaatcgggaaaattaaagagatcaaagaaggctatttgtctctggtaattcacgaaatcagcaagatggtgatcaagtataacgcgatcattgcgatggaggatctttcttatggcttcaagaaagggcgctttaaagtcgaacgccaggtctaccagaaatttgagacaatgcttatcaacaagcttaactatcttgtatttaaggatatttccatcactgagaacggaggacttttaaaggggtaccaactgacgtacattcctgataagctgaagaacgttggtcatcaatgcggatgcatcttctatgtgccagcggcttacacctccaaaatcgatcccactacaggctttgtcaatatcttcaaattcaaggatttgaccgttgacgcgaagcgcgagtttatcaagaagtttgatagcattcgctacgacagcgaaaaaaatttattttgttttactttcgactacaataactttattactcagaacactgtcatgtcaaagagttcgtggagtgtctacacgtacggagtacgtattaagcgccgtttcgtcaacggacgcttctcaaacgaaagcgacacgatcgacatcaccaaagacatggaaaaaactcttgagatgacggatatcaattggcgcgacggccatgacctgcgtcaggatatcattgattacgagatcgttcagcacatcttcgaaatcttccgccttaccgtccagatgcgcaacagtttaagcgagcttgaagaccgcgactacgatcgtttgattagccccgttctgaacgagaataatattttctacgacagcgcaaaggccggtgatgctttgccaaaggacgcagacgcgaatggagcctactgcatcgccctgaagggcttatatgagattaagcaaattaccgaaaattggaaggaagatggtaagttctcccgtgataagcttaaaattagcaataaggattggttcgacttcatccagaacaaacgttacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 72 - DNA, 3963 bp, Artificial Sequence
  Description of Artificial Sequence: Synthetic polynucleotide
agcccagcggctaaaaaaaagaaactggatggcagcgtggatatgaacaacggaacaaacaatttccaaaacttcatcggtatctcttcgttgcagaagactctgcgtaatgctttgatcccgacggagacaacccaacaatttatcgtcaaaaacggtattattaaggaggacgagttacgtggagaaaatcgtcaaatccttaaggacatcatggacgattattatcgcgggtttatttctgaaaccctgagcagtatcgatgatatcgactggacctcactttttgagaaaatggagatccagttgaagaacggtgataacaaagacactctgatcaaagagcaaactgaataccgcaaggcaattcacaaaaagttcgccaacgacgaccgtttcaagaatatgttctcagctaagttaatcagcgacattttgccagagttcgttatccacaacaataattatagtgcttcagagaaggaggaaaaaacccaagtgattaaacttttttcgcgctttgcaacctcattcaaggactacttcaagaatcgcgcgaattgcttcagtgcggacgacatttcttcttcaagttgccatcgtatcgttaacgataacgcggaaattttcttctctaatgctttggtgtatcgccgcattgtaaaatcgcttagtaacgatgacattaataagatctcaggtgatatgaaagattcattgaaggaaatgagcttggaagagatttacagttacgaaaaatatggagaatttattactcaggaaggcatctcattctataacgatatctgcgggaaggtaaattcgtttatgaacttatattgccagaaaaataaagagaataaaaatttgtataagcttcagaagttgcacaaacagatcctgtgcattgcagacacctcgtatgaggttccgtataaatttgagtccgatgaagaagtgtatcagtctgtgaatggtttcttagataatatctcttccaagcatattgtcgaacgcctgcgcaaaattggtgataactataacggatacaatctggataaaatttacatcgtttctaaattttacgagtcagtctcgcagaagacctaccgcgactgggaaacaattaacacggcattggagattcactacaataatatcttgcctggtaacggtaagtctaaggcagataaggtaaaaaaagctgtgaaaaacgaccttcagaaaagcatcacggagattaatgagctggtgagtaattacaaattatgttcagacgataatattaaagctgaaacgtatatccatgaaatctcgcatatcttgaacaacttcgaggcccaagaacttaaatataaccccgaaatccatttagtcgagtctgaattgaaagcgtcggaattaaaaaacgtcttagacgtcattatgaacgcgtttcactggtgttcagttttcatgaccgaagagctggtcgacaaagacaacaacttctatgcggaattggaggaaatctatgatgaaatctaccctgttatttcactgtataaccttgtgcgcaactatgtcactcagaagccgtattcgaccaaaaaaattaaattgaatttcggtatccctactcttgcagacggatggagtaaaagcaaggaatacagtaataacgccattattcttatgcgcgacaatttatactacctgggcatctttaacgcaaagaataagccggataagaagattattgagggtaacaccagtgagaacaagggcgactataagaagatgatctataacttattgccaggtccaaataaaatgatcccaaaagtattcttatcatcaaagacgggagttgaaacctataagcctagtgcctatattcttgagggatataaacagaacaagcacattaagtcgtctaaggattttgacattacgttctgccatgacttaatcgactattttaaaaactgtattgcgattcaccccgaatggaagaattttggattcgatttttcggatacctcgacctatgaagatatttcgggattttatcgtgaagtggagttgcaaggctataaaatcgattggacctatatctcagaaaaagacattgatttattacaggaaaagggacaactgtaccttttccaaatttataacaaggacttttctaaaaagtccacaggaaatgataaccttcacaccatgtacctgaagaaccttttctcagaggaaaacctgaaggacattgtccttaagttaaatggagaagcggagatctttttccgtaaatctagtatcaagaatccgattatccataaaaaaggttcgattttggtaaatcgcacctatgaagcggaagagaaagatcaatttggtaacatccagatcgtgcgcaagaatatcccggagaacatttaccaagagctgtataagtacttcaatgataagtctgataaggaactgtcagatgaagctgcgaaattgaagaacgtggttgggcatcatgaagccgctaccaatatcgtcaaggattaccgttatacctatgacaaatatttcttacacatgccgattacgatcaattttaaggcaaacaagacaggattcatcaacgaccgtatcttgcagtatattgccaaagagaaggatctgcatgtgatcggtattgaccgcggggagcgcaatttaatctatgtatcggtgatcgatacttgtggtaacatcgtagaacaaaagagctttaacatcgtgaatggttacgactatcagatcaagctgaaacaacaggaaggagcccgccagatcgctcgcaaggaatggaaagaaatcgggaaaattaaggaaatcaaggaaggctacctttcattggtcattcacgaaatttcgaaaatggtaattaagtacaacgcgatcatcgccatggaggacctttcgtacggatttaagaagggtcgtttcaaagttgagcgccaggtataccaaaaattcgagactatgcttatcaacaaacttaactacttggtctttaaggacatttctattaccgaaaacggcggcttacttaaaggctatcaattgacatatattcccgacaaactgaagaatgttggacatcaatgcgggtgtattttctatgtgccggcagcttacactagtaagatcgaccctacaaccgggttcgtaaacatttttaaattcaaagacttaacagtcgatgcgaagcgtgaatttattaagaagtttgatagtatccgctatgacagtgaaaagaacttgttttgctttacgttcgactacaataactttattacacagaacacggtcatgtctaaatcatcatggtcggtttacacatatggggtgcgcatcaagcgtcgctttgtaaatggccgttttagtaatgagagcgacacaatcgacatcacaaaggatatggagaaaactcttgagatgacagacatcaattggcgtgacggtcatgacttacgccaagatatcatcgactacgaaatcgtacagcatatttttgagatttttcgtcttactgtgcaaatgcgtaattctttatccgaactggaagatcgtgattacgaccgcttgattagtcccgtcttaaatgagaacaatattttctatgattctgcgaaagccggagatgcactgcccaaagacgctgatgccaatggcgcgtattgcattgcattaaaaggattatatgagattaaacagattaccgaaaattggaaagaggacggtaaattctcacgcgataaattgaagatttctaacaaggactggttcgactttatccaaaataaacgttatcttaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 73 - DNA, 3963 bp, Artificial Sequence
  Description of Artificial Sequence: Synthetic polynucleotide
agcccagcggctaaaaaaaagaaactggatggcagcgtggatatgaataacggtaccaacaactttcagaatttcattggcattagctcgcttcaaaaaactttacgcaatgctcttattccgactgagacgacacaacagtttatcgttaagaatggcatcatcaaagaagatgaattacgcggagaaaaccgccagatcctgaaagacattatggacgattattaccgtgggttcatctccgagacgttgtcatcgatcgatgacatcgactggacgtcactttttgaaaaaatggagatccagttaaagaacggtgacaataaggatacattgatcaaagaacagaccgagtaccgtaaagcgattcataaaaagtttgcgaacgatgatcgcttcaagaatatgttttctgcgaaattaatttccgacattttacctgaatttgttattcataataacaactactcggcgtctgagaaagaggagaaaacccaagtgattaaacttttttcacgtttcgcaacgtcgttcaaagactattttaaaaatcgtgctaattgctttagcgcggatgacatcagctctagttcatgtcatcgcattgtcaacgataatgctgagatctttttcagtaatgcgttagtgtaccgtcgtattgtgaagtccttatctaatgatgatatcaataagatcagcggggatatgaaggactcacttaaggagatgagcttggaggaaatctattcctatgagaagtatggtgagtttattacgcaagaaggaattagcttttacaacgatatctgtggaaaggtgaattcgtttatgaatttgtattgccagaaaaataaggagaacaagaacctttataaattgcaaaagttacacaagcaaatcctgtgcattgcagatacttcctacgaggtgccttacaagtttgaatccgacgaagaggtctaccaatctgtaaacggtttcttagataatattagttccaagcatattgtggagcgccttcgtaaaattggcgataattacaacggttacaatttagacaaaatttacattgtcagtaaattctacgagtccgtatctcaaaagacgtatcgtgattgggagactatcaatacggccctggagatccactacaacaatatcttgcccggtaatggtaagtcgaaggccgataaagttaagaaagcggtgaaaaatgacttacagaagtcaatcaccgaaattaacgaattggtgtccaattataaattgtgttcagatgataatatcaaagccgagacctacattcatgagatttcccatatcttaaataatttcgaggcgcaagagcttaagtataacccagaaatccacctggtagaatctgagttgaaggcgtcagagttaaaaaatgttttagatgtcattatgaacgcgtttcactggtgctccgtatttatgacggaggaattagtagataaagacaacaatttctatgccgaacttgaggaaatctatgatgagatctatcccgtcattagcctgtataacttggtccgcaactatgttacccaaaaaccgtacagtaccaagaagattaagctgaatttcggcattcctacactggctgatggttggagtaaatcgaaggaatattcgaataacgcgattatcttgatgcgcgacaacttatactatttggggatctttaacgccaaaaacaaaccggataagaagattattgagggaaacacatcagagaacaaaggcgactacaaaaaaatgatttacaacttgttaccggggcctaacaaaatgatcccgaaggtgttcttatccagtaaaacaggcgttgagacctacaaaccttccgcatacatcctggaagggtataagcagaacaagcacattaagtccagcaaggatttcgatattaccttctgtcatgatttaattgactatttcaagaactgtattgcaatccaccccgagtggaagaacttcggattcgacttctcagatacgagcacatatgaggacatctcggggttctatcgtgaagtagaactgcagggatataaaattgattggacatatatttccgaaaaagacatcgaccttttacaagagaagggtcaactttacttgttccaaatttacaataaagacttctcaaaaaaaagcacgggtaacgataatttacacactatgtatttaaagaaccttttctcggaagagaatttaaaggatatcgtattgaagttgaatggagaagcggagatcttcttccgtaagtccagtattaaaaaccctattattcacaagaagggatcgattttagttaaccgcacatacgaggccgaagagaaggaccaatttgggaacattcaaattgtccgcaaaaacatccctgagaacatttatcaagagctttataagtactttaacgataagtccgataaggaattgtcagatgaggcggcaaagttgaagaatgtcgtggggcatcatgaagctgccaccaacattgtgaaggactaccgctacacttacgacaaatacttcctgcacatgcccattacgatcaattttaaggccaataagacaggctttattaacgaccgtattcttcaatatatcgctaaggagaaggaccttcatgtgattgggatcgaccgcggagaacgtaatttaatttatgtgtccgtcatcgatacgtgtggaaatatcgtggaacagaaatcattcaatatcgtgaatggctatgattaccagatcaaattaaaacagcaggagggcgctcgccaaattgcgcgtaaggaatggaaagagatcggaaaaatcaaagaaatcaaagaaggatatttgtcattggtgatccatgagatttcaaaaatggtaattaaatataatgcaattatcgcaatggaagacctgtcctatggttttaagaagggtcgtttcaaggtagaacgccaagtgtatcaaaagttcgagacgatgctgatcaataagctgaattatcttgtgtttaaggacattagcatcacggaaaatggagggctgttgaaaggctatcaactgacgtatatccctgacaagctgaaaaatgttggccatcagtgcgggtgcattttctacgtccccgcggcgtatacaagcaagatcgatcctactacgggattcgtaaatatttttaaattcaaagacttaaccgtggacgccaagcgcgaattcattaagaagtttgatagcattcgctacgattcagaaaaaaatcttttctgttttacgttcgattacaacaattttatcacccagaacacagtgatgagcaagtcatcctggtctgtctatacctacggtgtccgtatcaaacgccgcttcgtcaacggacgcttctctaatgaatctgataccattgacatcaccaaggacatggaaaagacacttgagatgacagatattaactggcgtgacggacatgacctgcgtcaggacatcatcgattatgagattgttcagcatatcttcgagatcttccgcctgacagtacaaatgcgcaattcactgtcagaacttgaagaccgcgactatgaccgcctgatctctccagtattaaatgagaacaatatcttttatgacagtgctaaggccggcgatgcccttccgaaagatgctgatgctaacggagcttattgtattgcattaaagggtctttatgagatcaagcaaattaccgagaattggaaggaggatggcaaattctcgcgcgacaaactgaaaatcagtaacaaggactggttcgattttattcagaataaacgttacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 74 - DNA, 3963 bp, Artificial Sequence
  Description of Artificial Sequence: Synthetic polynucleotide
agcccagcggctaaaaaaaagaaactggatggcagcgtggatatgaataacggaacgaacaacttccagaacttcatcggcatcagttctttacaaaaaaccctgcgtaacgcccttattccgactgagacaacacaacagttcatcgttaaaaacggaattatcaaagaggacgagttgcgcggcgagaatcgccaaattttgaaagatattatggacgactattatcgtggttttatttcagaaacactgagttcgattgacgatatcgattggacgagcctgtttgagaaaatggaaatccagttgaaaaatggcgataataaagacactttaatcaaagaacaaaccgagtatcgtaaagcgatccataaaaagttcgctaatgacgatcgttttaagaatatgttcagtgcgaaactgatttcagacattttgcccgagttcgtgatccataataacaactattccgcctcggaaaaggaagaaaaaacccaggtgattaagctgttcagtcgcttcgcaacatctttcaaggattatttcaagaatcgcgcgaattgcttcagtgcggacgatatttctagttcaagctgccatcgtatcgttaatgataacgcggagattttttttagcaatgctctggtgtaccgccgcattgttaagtcactgtccaacgatgatattaacaagatctcaggagacatgaaagactcgcttaaagagatgagtctggaagagatctattcttatgagaagtatggcgagtttattacccaagaaggaatctcattctacaatgatatttgtggaaaggtgaacagctttatgaatctttactgccaaaaaaacaaggagaataagaatctttacaaacttcagaagttacataaacagattttgtgtattgcggatacgtcttatgaagtcccctacaaatttgaatcggatgaagaggtataccaaagtgtgaacggattcttggacaatatttcttctaaacatattgttgaacgcttacgtaagatcggggataactacaatggctacaatcttgacaaaatctacattgttagcaaattctacgagagtgtcagccaaaagacgtaccgcgattgggaaacaattaatactgcgcttgagattcactataataacattttaccaggcaacggcaagtccaaggcggataaagttaaaaaagctgttaaaaacgatttgcaaaaatctatcacagaaattaacgagttagttagtaactacaaactgtgctccgatgacaacattaaggctgagacgtatatccatgagatctctcacatcttaaacaattttgaagctcaagaacttaagtacaatccggaaatccacctggtggaatccgagctgaaggctagcgaactgaagaacgtattggacgtgatcatgaacgcgttccactggtgttctgtctttatgacggaagagcttgtcgacaaagataataacttttacgcggaacttgaggaaatttacgatgagatttacccagttatttcattgtataaccttgtccgtaattacgtgacccaaaagccttatagtacgaaaaaaatcaaattaaattttggaatcccaacactggctgacggttggagcaaatctaaggagtattctaataacgcaatcatcttaatgcgtgacaacctgtattatttgggtatcttcaatgccaaaaataagcctgacaaaaagattatcgaaggaaatacttcggagaataagggggattacaaaaaaatgatttacaatttgctgcccgggccgaacaagatgatccccaaagtgttcttatcctcgaagactggtgtagaaacatacaagccaagcgcatacattctggagggttacaagcaaaacaaacacatcaaatcttcaaaagactttgacattacattttgccatgatcttattgactacttcaaaaactgcattgctattcaccccgagtggaagaactttgggtttgacttcagcgacacgtctacgtatgaggacatctccgggttctaccgtgaagttgagttacaagggtataagattgactggacgtatatttcagagaaagatatcgatcttttgcaggaaaagggccagttatatttattccagatttacaacaaggactttagtaagaagtcaacaggaaatgacaacttgcatacgatgtatttgaaaaatcttttttctgaggaaaatcttaaggacatcgtactgaaattgaatggcgaggctgaaatcttcttccgtaaatcctccattaagaatcccattatccacaaaaaggggtctatcctggtgaatcgtacctacgaggcagaggagaaggatcaattcggaaatattcagattgttcgtaagaacatccccgagaacatttatcaagaattgtataagtactttaatgacaaatctgacaaagagttatccgacgaagctgcgaaactgaaaaacgttgttggtcaccacgaggccgccactaatatcgtaaaagactaccgttatacctatgacaagtactttttgcacatgccgatcactatcaacttcaaggcgaataagacgggcttcattaacgatcgtatcctgcaatacatcgccaaggagaaggaccttcacgtcattgggattgaccgtggtgagcgtaacctgatttatgtaagcgtcattgatacctgcggtaatatcgtcgaacagaaaagtttcaacattgtaaatggatatgactatcagatcaaacttaagcagcaggagggtgcacgccagattgcccgcaaggaatggaaggagattgggaagattaaggaaattaaagaaggttacttatcactggttattcacgagatcagtaaaatggtaatcaaatataacgcgatcattgccatggaggatctgagctatggctttaaaaagggccgtttcaaagtcgagcgccaggtatatcaaaagtttgaaacaatgctgattaacaaattaaactatctggttttcaaagatatttcgatcactgaaaatggcgggctgttgaagggataccaacttacatacatccctgacaaactgaaaaatgtcggtcaccaatgtggatgtatcttttatgtaccagcagcgtatacgagcaaaatcgatccaactacgggttttgtgaacatctttaagttcaaggatttgacagtagatgccaaacgcgagttcattaaaaaatttgattcaattcgctacgattcagagaaaaatcttttttgtttcacgttcgattacaataatttcattacgcagaacacagtaatgtcaaagtcaagctggtcggtctacacgtatggagtccgtattaaacgtcgttttgtaaacggccgtttctcaaatgaatcagatacaattgatattacgaaggatatggagaagacattagagatgactgacattaactggcgcgacggacatgatcttcgtcaggacattattgattatgagattgtacagcatatctttgagatcttccgcctgaccgttcagatgcgcaattcgttgtccgagttagaagaccgcgattacgaccgtttaatcagtcccgtcttaaacgaaaataacatcttctacgattcagccaaggcaggcgatgccttgccaaaggatgctgacgcaaatggcgcatactgtattgcgttgaaaggcctttatgaaatcaagcaaattaccgaaaactggaaagaagacggaaaattctcccgtgataagttgaaaatctctaataaggattggttcgatttcatccaaaataaacgctatttgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 75 - DNA, 3962 bp, Artificial Sequence
  Description of Artificial Sequence: Synthetic polynucleotide
agcccagcggctaaaaaaaagaaactggatggcagcgtggatatgaacaacggaactaataatttccaaaattttataggcatctcttctttacagaagactcttcgtaacgccctaatcccgactgagaccacacaacaattcatagtgaaaaatgggatcattaaagaagacgagctgcgtggggagaacaggcagatcctaaaagacataatggacgattattatagagggttcatctcagagacattatctagcatcgacgacattgactggacctccctgtttgaaaaaatggaaatccagctgaagaatggtgacaataaagacacattaataaaagaacaaacagagtacaggaaagccatccacaagaagttcgcaaacgatgacagattcaaaaatatgttcagtgcgaagctaatatccgacatcttaccagagtttgtaatacacaataacaattacagcgcgagcgaaaaggaagagaaaacgcaagtaattaagctttttagtaggttcgctacctctttcaaagattacttcaaaaatcgtgctaactgcttctcagccgacgacatatcttcaagttcctgtcaccgtatcgtgaatgataacgctgagatattcttctcaaacgcccttgtataccgtaggatcgtaaagtccttatctaacgatgatataaacaagatcagtggagacatgaaagacagccttaaagagatgtctctagaagaaatttactcctatgaaaagtatggggagtttataacacaggaggggatcagcttctacaacgacatctgcggaaaggtgaacagtttcatgaatctttactgccagaagaataaagagaacaaaaatctttataagcttcaaaagttgcacaaacaaatactgtgcattgccgatacatcatatgaggtcccctataagttcgaatctgatgaggaagtttatcaatctgttaacggctttctagacaatatcagctcaaaacacatcgtagaaagactgaggaaaataggtgataattataatggatacaacttggataaaatatatatagtctctaaattttacgagtcagtatcccagaaaacgtatagggattgggagaccatcaacacggcgttagagattcattacaataacatcttaccgggaaacggaaaaagtaaggcggacaaagtaaagaaagccgttaaaaatgacttacaaaagagtataacagaaataaacgaactagtaagcaactacaagctttgttccgatgataatatcaaggccgagacatatatccatgagatctcccacattctaaacaatttcgaagcgcaagaacttaaatataatcccgaaatccacctggtggaaagtgaactaaaggctagtgagttaaagaacgttcttgatgttatcatgaacgccttccattggtgctctgtttttatgaccgaggagttggttgataaagataataatttctacgctgaattagaggagatatacgacgaaatctacccagtgatttcactatacaacttggtcaggaactatgttacacaaaagccgtacagcactaagaaaattaagctaaatttcggtatccccacgttagccgacgggtggagcaagtccaaagaatattccaacaatgcgattattttaatgcgtgacaatctttattaccttggcatcttcaatgccaaaaacaaacctgacaaaaagattatagaaggtaatacgtccgagaacaaaggcgattacaagaagatgatttataacctactgcccggaccaaacaaaatgatccccaaagtttttcttagttctaaaaccggcgtagagacgtataaaccttctgcctatatcttagagggatataagcagaacaaacatatcaaatcttccaaggactttgatattacattctgccacgatttaattgactacttcaaaaattgcatagcgatacatccggagtggaagaactttggcttcgacttcagtgatacatccacctatgaggatatatcaggcttctatcgtgaggtcgaattgcaagggtacaaaatcgattggacgtatatatccgagaaagacatagaccttcttcaagaaaaggggcagttatatttattccaaatatacaacaaggacttcagtaagaagtcaacaggtaatgacaacttacacaccatgtacttgaaaaatttattttctgaagaaaacctaaaggacattgtactaaaactgaacggggaggcagaaattttttttagaaagagcagcataaaaaacccaataattcataagaaaggaagcattttagttaataggacgtacgaggcagaggaaaaggaccagtttggcaatatccagatcgtaaggaaaaatattcctgaaaacatatatcaggaactatataaatactttaacgacaaatccgacaaagaattatccgacgaggctgcaaagctgaagaacgtcgtagggcaccatgaggcagcgactaatattgtgaaagactataggtatacatacgacaaatactttctgcacatgcccatcacgattaacttcaaggcgaacaagacgggattcattaacgaccgtatattacaatatattgctaaggagaaagatctgcatgtaataggtatcgacagaggcgaacgtaatttaatctacgtgtccgtcatcgacacgtgcgggaacatcgtagagcaaaagagttttaatatagtaaatggctatgattaccaaattaagctaaagcagcaagaaggagcaagacagatagctaggaaagaatggaaggagataggaaaaataaaggagatcaaggaggggtatcttagcctagtaattcatgaaatatctaagatggttatcaaatacaacgctatcatagcgatggaagacttatcttatggtttcaagaaaggaaggttcaaagtagagcgtcaagtttatcaaaagttcgaaacgatgttgattaataaactaaactatttggtatttaaagatatatctatcaccgagaatggtggtctactaaagggttaccagcttacatacataccggacaaacttaaaaacgtcggacatcagtgtggatgcattttctacgttccagctgcatataccagcaagatcgacccaacgactgggttcgtaaatatttttaaattcaaggatttgactgtcgacgccaaaagagagttcataaaaaagttcgattcaattaggtacgacagcgaaaagaatttgttctgctttacttttgactataacaatttcattactcagaacactgtaatgtctaagtcctcttggtcagtctatacttatggcgttcgtatcaaacgtagatttgttaacggtagattctcaaatgaaagtgatacaatagatatcacgaaagatatggagaaaacattagaaatgacagacataaactggagagacggacatgacttgagacaggacattattgactacgagatcgtgcagcacatctttgagatctttcgtttgaccgtacaaatgcgtaacagtttatctgagcttgaggacagggactacgatagattgatatcacctgtattaaatgagaataacatcttctatgattccgcaaaagcaggcgacgctctacccaaagacgctgatgcgaacggtgcttattgcatagctttaaagggtttgtatgagatcaaacagataacagaaaattggaaggaagatggtaagttctcccgtgacaagcttaaaatatcaaataaggactggttcgattttatacagaataagcgttattaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 76 - DNA, 3963 bp, Artificial Sequence
  Description of Artificial Sequence: Synthetic polynucleotide
agcccagcggctaaaaaaaagaaactggatggcagcgtggatatgaacaatggaactaataacttccagaatttcattggtatctcctctttacaaaaaactctaagaaacgccctaattccgactgaaactacacagcaattcatcgtcaaaaacgggatcattaaggaggatgagttgaggggtgaaaatcgtcaaattcttaaagacatcatggacgactactacagggggttcatcagcgagacgttatctagtatagacgatatagactggacttcactgttcgagaagatggaaatccaattaaaaaatggggacaataaagatacacttataaaggaacagacagagtatagaaaggcaatacacaaaaagtttgccaacgacgatcgtttcaagaacatgtttagtgctaaattgatttcagatattctgccggaatttgttattcacaacaataattatagcgccagtgagaaagaagaaaaaacgcaggttatcaaactgttcagtcgtttcgctacatcttttaaggattactttaaaaaccgtgcaaattgtttttcagccgacgatattagtagcagctcttgtcaccgtattgttaatgataatgcggagattttcttttcaaacgcattggtctacaggaggatagtcaagtccctttcaaatgacgacattaataagatctcaggtgacatgaaagattccttaaaggaaatgtccctggaagagatctattcctatgaaaagtacggtgagttcattactcaagagggtataagcttttacaatgacatatgtggtaaggttaatagctttatgaacctgtattgccagaagaacaaagaaaataagaatctgtataagttgcaaaagctacacaaacaaattttgtgcattgccgatacatcatacgaggtgccatacaaattcgagagcgatgaggaggtttatcagagcgtgaatggattcctggacaatattagtagtaagcatatcgtggaaaggcttagaaagataggtgacaattacaatggctacaatctggataaaatctacatcgtctcaaaattctatgaaagtgtatcccagaagacgtaccgtgattgggaaactatcaacaccgctctggagatacattacaacaatatacttcccggaaacggcaagtcaaaagccgacaaagtcaaaaaagcggtcaagaacgatttacaaaagtctatcactgaaattaatgaattagttagtaattacaaactgtgtagtgatgataatattaaggcagagacttacatacacgaaatttcacacattttaaacaacttcgaggcacaggaacttaaatataatcctgaaattcacctggttgaaagtgaattgaaagccagcgagctaaagaacgttttggacgtaatcatgaacgcattccactggtgctctgtctttatgacagaggaactagtggataaggacaataatttttatgcggagctggaggaaatatacgatgagatatatcccgtaatatcattatataatctggtaagaaactatgtgactcaaaagccgtatagcaccaagaaaattaaacttaatttcggcatacccactttagcggacggctggtcaaaatccaaagagtatagtaataatgccatcatcctgatgcgtgacaacctgtactatttaggtatatttaacgccaaaaataaacccgacaaaaagattatagagggcaacacctcagagaacaaaggtgattataagaagatgatttacaaccttttacccggtcctaataagatgattcccaaagtctttctatctagcaaaactggtgttgaaacatacaaaccctcagcttatattttagaagggtataagcagaataagcatattaaaagctccaaagatttcgatattaccttttgccatgacttgatagactatttcaaaaattgtattgccattcaccctgaatggaaaaacttcggatttgacttctctgacacatccacctacgaagacatttcaggtttttacagggaagtcgagctacagggttataaaattgattggacatacatcagcgagaaagatattgacctacttcaagaaaaagggcagctatacctgttccagatatacaataaagacttcagtaaaaaaagcaccgggaacgataatcttcacacaatgtacttaaaaaatttatttagtgaagagaatctgaaggatatagtgctgaagttaaacggggaggcagagatattttttagaaaatctagtattaagaatccgatcatccacaagaagggttctatccttgttaataggacttatgaggcagaagaaaaagaccaattcggcaacatacaaattgtccgtaaaaatatccctgagaacatttatcaggaactatacaagtacttcaatgataaaagcgacaaggagctgagcgacgaggctgctaagttaaagaatgtggtgggccaccatgaggcagcaacgaatattgtgaaggactatcgttatacctacgataaatactttcttcatatgccgatcaccattaatttcaaggcaaacaaaactggcttcattaacgatcgtatcttacaatatatcgcaaaagagaaagaccttcacgttatcgggatcgatagaggcgagcgtaacctaatttatgtttctgtgatagacacctgtgggaacatagtcgaacagaaatcatttaatattgttaacggctacgattatcagataaagttgaagcaacaagagggtgcacgtcaaatagcaaggaaagaatggaaagaaataggcaagattaaagaaataaaagaaggttatttatcccttgtaatacacgaaattagcaaaatggtgattaaatataatgcgatcattgccatggaggatctttcttacggcttcaaaaaggggagattcaaagtcgagaggcaggtgtatcagaagtttgagaccatgctaatcaataaactaaattatctagtattcaaagacataagcatcaccgaaaatggcggcttgttgaagggttatcaattgacctacatcccagataaactaaaaaacgtagggcatcaatgcggatgtatattttacgttccagccgcatacacttccaaaatcgatccaactacgggttttgtgaacatcttcaaattcaaagacttgactgtcgatgctaagagggagtttatcaagaaatttgactccattagatacgacagtgagaagaatctgttctgttttacctttgattataacaactttataactcaaaacacagtcatgagtaagtcatcttggtcagtgtatacgtatggtgtgaggattaaaaggaggtttgttaacgggagattttccaatgaaagtgatacaatagatataaccaaggacatggaaaagactcttgaaatgaccgacattaactggagagatggccacgacttacgtcaagatataatcgattacgagatagtgcaacatatctttgagatatttaggcttactgtccaaatgcgtaactcattaagtgagttggaggacagggattacgataggctaataagtcctgttcttaacgaaaacaatatattctacgattcagcaaaggcgggagacgccctgcccaaggacgcggatgctaacggcgcatactgtattgccctgaaaggcttgtacgagataaaacagatcacggagaactggaaagaagatggaaaattcagtcgtgacaagttaaaaattagtaacaaagactggttcgactttattcagaacaagagatatctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 77 - DNA, 3963 bp, Artificial Sequence
  Description of Artificial Sequence: Synthetic polynucleotide
agcccagcggctaaaaaaaagaaactggatggcagcgtggatatgaacaacggaaccaataactttcaaaactttataggcatctccagtctacagaagacactacgtaacgctttgataccaactgagaccacgcagcagtttatcgtcaagaacggtattataaaggaagacgagctaaggggggaaaaccgtcagatcttaaaggacatcatggatgactactacagaggcttcataagtgagactttgtctagtatagacgacatcgactggaccagtttatttgagaagatggaaattcagttaaagaacggggacaataaagacacactaattaaagagcagaccgaatacagaaaagctatacacaaaaagtttgccaacgatgatagattcaaaaatatgttttcagcaaaattgatttccgacatattgccagaattcgtaatccataataacaattattctgcaagtgagaaggaagagaagacccaagtaatcaagctgttttcccgttttgctacgagtttcaaagattatttcaagaatagggctaattgtttctccgcggacgacataagtagcagttcctgtcacaggattgtgaacgataatgctgagatatttttttccaatgccctagtgtataggagaatagttaaaagcttaagcaacgacgatatcaataaaatttcaggggacatgaaggacagcttaaaggaaatgagtttggaggagatttacagttatgaaaaatacggagagtttataactcaggaaggcatctctttctataatgatatctgtgggaaggtaaactccttcatgaatttatattgccagaagaataaggaaaacaaaaatctttacaagcttcaaaagttacataagcagatcttatgtattgccgacacgagttatgaagtgccttataaattcgagagtgatgaggaagtgtatcagtctgttaacggattcctagataatataagttccaaacatatagtcgagaggctgaggaagattggcgataactataatggatataatcttgacaaaatctatatagtctctaaattttatgaaagcgtcagccagaagacatatagagattgggaaactataaacacagcccttgaaatacattacaataacatcctacccggcaatggtaagtctaaggcagacaaagttaaaaaagcagtaaagaatgacttacagaagtcaatcacggagataaatgagttggtcagtaactacaaattatgctccgacgataatattaaggccgaaacatatatacacgagataagtcatatattaaacaatttcgaagcccaggagttaaaatataaccctgaaattcatctggtcgaaagtgagttaaaggccagtgagttaaagaatgtacttgacgtaattatgaatgcttttcattggtgctccgtgttcatgaccgaggagttagtagataaagacaataacttttacgccgaacttgaagagatatacgacgagatttatccggtaatcagcttgtacaacttagttagaaattatgtaacacagaagccttactctactaaaaaaataaaactgaactttggtatcccaactcttgcagatggttggagtaaaagcaaggaatatagcaacaatgcgatcatcttgatgagagacaacttgtactatttgggaatcttcaacgcgaaaaataaacccgacaaaaaaatcatcgaagggaatacctctgagaataaaggtgactataagaaaatgatttacaatctacttcctggtcctaataaaatgatcccgaaagtgtttcttagttctaagactggtgtcgagacgtacaaacctagcgcgtacatcttagaagggtacaagcagaataaacacatcaaatcaagcaaagacttcgatattactttttgccatgacttgatagactactttaaaaactgcatagcaatccacccggagtggaaaaactttggctttgatttctctgacacctctacatatgaggacatatctggtttttaccgtgaggttgaattgcagggatacaaaattgactggacttacatatctgaaaaagatatcgatctattgcaggagaaaggccagctttaccttttccagatctataataaggacttctctaagaagtctacagggaatgataatttgcacactatgtacttaaaaaatctgttttccgaggaaaacttgaaagacattgttttaaagttgaacggagaagctgaaatatttttcagaaagagctccataaaaaacccgatcattcataagaagggatctatcctggttaacagaacgtacgaagcggaagaaaaagaccaattcggaaacattcaaattgttagaaagaatatccctgagaacatctaccaggagttatataagtattttaatgataagtcagataaggaactatctgacgaagcggcgaagcttaaaaatgttgtaggacaccatgaggctgctacaaatatagtcaaggactaccgttatacctacgataagtactttctacacatgcccattaccatcaattttaaagctaataaaacgggttttatcaacgatcgtatcctacaatatattgcgaaagagaaggatttgcatgtcattggcattgatagaggtgagaggaacctaatatacgtatccgtgattgatacgtgcgggaacatagttgaacagaaatcatttaatatagttaatgggtacgactatcagattaagctaaagcaacaagaaggcgccaggcaaattgcccgtaaagaatggaaagagatcgggaagatcaaggaaataaaagaaggatacctttccctggtcatccatgaaattagcaaaatggtgattaagtacaatgccataatcgcgatggaggacttaagctacgggttcaaaaaggggaggtttaaggtggagaggcaagtgtaccagaaatttgagaccatgctaatcaacaaactgaactacctagtttttaaggacatttcaattacagagaatggaggacttttaaagggttaccaactaacgtatataccagataagttgaaaaatgtcggtcaccagtgtggctgcatcttttacgttcccgccgcttatacatctaaaattgatccaaccacaggctttgtaaatatctttaaattcaaagatttaactgtggatgcaaaaagagagtttatcaagaaattcgatagcattcgttatgatagcgagaagaacctgttctgctttactttcgactataacaactttataactcaaaacaccgtgatgtcaaaaagctcatggtcagtctacacctatggtgtaaggattaaaaggcgtttcgtgaatgggagattctccaatgaaagtgacacgatcgacataacaaaggacatggagaagacactagagatgactgatattaattggagagacggacacgatctgcgtcaagatataattgattatgagatagtacagcacatatttgagatcttccgtttgactgtccaaatgcgtaattccctttctgagctggaagatagggactatgatagattaatatcccctgtactaaatgagaacaacattttctatgatagtgcaaaagccggggatgcattgccgaaagacgctgacgctaatggggcgtactgtatagctttaaaggggctttacgaaataaagcagataaccgaaaactggaaggaagatggcaaattctcaagggacaaacttaagatctctaacaaggattggttcgattttatacaaaacaaacgttatttgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 78 - DNA, 3963 bp, Artificial Sequence
  Description of Artificial Sequence: Synthetic polynucleotide
agcccagcggctaaaaaaaagaaactggatggcagcgtggatatgaataatggtacaaacaactttcagaatttcattgggatctctagcttacagaagaccctgaggaatgcgttgattccaactgaaacaacccagcaattcatcgtgaaaaatgggataatcaaagaggatgagttaaggggtgaaaaccgtcaaatattgaaggatattatggacgactactaccgtggattcatctcagagacgttgagcagcattgacgacatagactggactagccttttcgagaagatggaaattcagttaaagaacggagataacaaagatacactaatcaaggaacagacagaatacagaaaagcaattcataagaaattcgctaatgacgatcgttttaaaaacatgttctctgcaaaattaattagcgacattctgccggaattcgttatacataataataactacagtgcttctgaaaaggaagagaaaactcaggtaataaaactgttctctcgttttgccacatccttcaaagactactttaaaaatagagcgaactgctttagcgccgacgatattagttcttcctcatgccacaggattgtcaacgataatgcagagatattcttttctaacgcactagtctacagaaggattgtaaagtctttgtcaaatgatgacataaacaagattagtggagatatgaaagactctctaaaggaaatgagccttgaggagatatactcttatgaaaagtacggtgagtttattacccaagaaggcattagtttctataatgacatttgtggaaaagttaacagttttatgaatctatactgtcaaaaaaataaggagaataaaaatctttataagttgcaaaaactgcataagcagatattatgtatagcagacacgagctatgaggtaccgtacaagttcgagagcgatgaggaagtctaccaatctgtcaacggatttttggacaacatttcttcaaaacatattgtggagaggcttaggaaaataggcgacaattataatggatataacttagataagatatatattgtttccaaattctacgaatctgtaagccagaagacatacagagattgggaaacgataaacacagcccttgaaattcactataacaacatactacctggaaacggcaaatcaaaggccgacaaagttaagaaggccgtaaagaatgatttacagaagagcataacggagatcaatgagctggtgtctaactataaattgtgtagcgatgacaacataaaagccgagacttacattcacgaaatttcacacatacttaacaactttgaagctcaggaattaaagtataatcccgaaatacaccttgtggagtccgaactaaaggctagtgagcttaagaacgtcctagacgtaattatgaatgccttccactggtgtagtgtttttatgaccgaggaacttgttgacaaagataataatttttatgcagaactagaagagatatacgatgaaatatacccggtgatcagtttgtacaatcttgtcaggaactatgtgacacaaaagccctattcaacaaagaaaataaaacttaatttcggaattcctacgttagctgatggctggtctaaatccaaggaatacagcaacaacgctataattctgatgagagataacttgtactatctaggcatcttcaatgccaaaaataagcctgataagaagattatagagggcaacacttcagagaacaagggcgactacaagaaaatgatctataacctattgcctggcccaaacaagatgattccgaaggtcttcctatcatccaagaccggcgttgagacatacaagccatcagcgtatattttagaggggtacaaacaaaacaagcacataaagtctagtaaagacttcgatataacattttgtcatgacttaattgactactttaagaattgcatcgctatacacccggaatggaagaatttcggcttcgacttctctgatacatctacctacgaggacattagcgggttttaccgtgaagtcgaattacaagggtataagatagattggacgtacatctctgagaaagacatagacttgcttcaggaaaagggccagttgtatctattccaaatatacaataaggatttttccaagaaatctacgggtaatgacaatcttcacacaatgtatcttaagaaccttttctcagaagagaacctgaaggacattgtcttaaaactaaatggcgaagctgagatttttttcaggaagtcttcaattaagaacccgataatccacaagaaggggagtattcttgtgaatagaacttacgaggccgaagaaaaagaccaatttggtaacatccagatagtcagaaagaacattccagagaacatctaccaagagctatacaaatatttcaacgacaagtccgataaggaactgtccgatgaggcagccaagttgaagaatgtcgtgggtcatcatgaagctgctactaacattgtcaaggactatcgttatacttacgacaagtatttcctacacatgccgataacaattaatttcaaggctaacaaaacaggctttatcaacgatcgtatcttgcagtacatagctaaggaaaaggatttgcatgtgattggcattgatagaggggagcgtaacttgatatatgtgtctgtcatagacacgtgtggcaacatcgtcgaacagaaatcattcaacatagtaaacggctacgattaccaaattaagctgaaacagcaagagggtgcacgtcaaattgcgcgtaaagagtggaaagaaattggtaaaatcaaggaaattaaagaaggctacttgtctcttgttatacatgaaatttccaagatggttataaagtataacgcgataattgctatggaagacttatcatacgggtttaaaaaggggaggttcaaggtagagaggcaggtctatcaaaagttcgagacgatgttgattaataaactaaactatctagtgttcaaagatatcagcattacggagaacggggggctactgaaaggatatcaactaacgtacattcccgataagttaaagaacgttggtcatcaatgtggttgcatcttctacgtgcctgctgcctatacgtccaaaatagatccaactactggatttgttaacatctttaaattcaaagatttaaccgtagacgccaaaagggaatttataaaaaaatttgacagcatccgttacgatagcgaaaagaatctgttctgttttactttcgactacaataatttcatcacgcaaaatacggtaatgtctaagtcaagttggagcgtctacacgtatggagtcaggatcaagaggcgtttcgtaaatggaagattctctaatgagtcagatactatagacatcacgaaagatatggagaaaaccttggagatgacggatattaactggcgtgatggacacgatttaagacaggacattattgactatgagattgtgcaacacatcttcgaaatattccgtctaacagtccaaatgaggaatagcctaagtgaattggaggaccgtgattacgataggcttataagtcctgtccttaacgaaaacaatattttctatgatagtgctaaggcgggggacgcactgcctaaagacgcagatgctaacggggcatactgcattgcgttaaagggtctgtacgaaatcaagcagattacggaaaactggaaagaggatggcaagtttagcagagataagttgaagataagtaacaaagattggtttgactttattcagaataaaaggtatttaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 79 - DNA, 3963 bp, Artificial Sequence
  Description of Artificial Sequence: Synthetic polynucleotide
agcccagcggctaaaaaaaagaaactggatggcagcgtggatatgaataacggcactaataatttccagaatttcatcggcattagcagcttacaaaagacgttgaggaatgccttaatacccacagaaactactcaacaatttatagtgaagaatgggataattaaggaagacgagttgagaggtgaaaataggcaaatcttgaaagacattatggatgactactacaggggcttcattagtgaaacgttgtcttcaatagatgacattgattggacttctttgtttgagaagatggaaatacagttaaagaacggcgacaataaggatacacttatcaaagagcaaacagaatatagaaaagcaattcacaaaaagtttgctaacgatgataggttcaagaacatgtttagcgctaaactaatatcagacatccttcccgagttcgttattcataacaataactatagtgcaagtgaaaaagaggagaagacacaggtgattaagctgttctccagattcgcgacttctttcaaagattacttcaaaaacagagccaactgtttttcagctgacgatatctctagtagtagttgtcaccgtatagtgaacgataacgctgagatcttctttagcaatgcattagtgtatagaaggatagttaagtctctaagcaatgatgatatcaataaaatttccggagacatgaaggactccctaaaggaaatgtccttagaagagatctactcatatgagaaatacggggaatttattacgcaggaagggatctccttttacaatgacatatgcgggaaggtcaactctttcatgaacttatactgccaaaagaacaaggagaacaagaatttatataaacttcagaaacttcacaaacaaatactgtgcatagccgatacctcatatgaggttccttacaaatttgaatcagatgaagaggtataccaatccgttaacggctttcttgacaatattagctcaaagcacatcgtggagaggttgagaaagattggtgataattataatggctacaatctagataagatatatattgttagcaagttctacgagtctgtgtcccaaaaaacatatagggattgggagacaattaatactgctctagaaatccattacaacaacatccttcctggaaatggcaagagtaaggccgacaaagtcaagaaagcagtgaaaaatgatctgcaaaaatcaattactgagataaacgagctagtatctaattacaagctttgtagcgacgataacattaaggcagaaacgtacatacacgagattagtcacatcttaaataattttgaagcccaagaactgaaatataaccctgagatacaccttgttgaatccgagttaaaggcgtctgaactaaaaaacgtgttagacgttattatgaatgccttccactggtgtagcgtctttatgactgaggagttggttgataaggataataacttttacgctgaattggaagaaatttatgacgaaatctatcctgttatttctctatataatttggtgagaaattacgtaacgcaaaagccctatagtacgaaaaaaataaaactaaatttcgggatccctaccctagccgacggttggtctaaatccaaggagtactcaaacaatgcaataatattgatgagggacaacctgtactacctaggcatatttaatgccaaaaataagcccgataaaaagattatagaagggaacacgtcagaaaataaaggagactataagaaaatgatctacaaccttttgcccggccccaataaaatgatcccgaaggtcttcctaagtagcaagactggcgtagagacctacaaaccatctgcatacattttggaggggtacaagcaaaacaagcacataaagagtagtaaggattttgacattacattctgccatgacttaattgactactttaaaaattgcatcgcaattcaccctgaatggaaaaattttggatttgatttctctgatacttcaacatatgaggatatttcagggttctacagggaggtcgaactacagggttacaaaatagactggacgtatatttctgagaaagatatagatttgcttcaggaaaagggtcagctatatctgttccagatatataataaggacttctccaaaaagagtaccggaaatgataatctgcacacaatgtacttaaaaaacttgttctctgaggagaatctaaaagacatcgtactaaaacttaacggggaggccgaaattttttttaggaagtccagcatcaagaacccgattattcataaaaaaggtagcattttggtgaaccgtacttatgaggcggaagaaaaagaccaattcggtaatattcaaatcgttagaaagaacatccctgagaacatttatcaggaactatacaaatactttaacgacaaatcagataaggagctttctgatgaggcagctaaattgaaaaatgtagtgggacatcacgaagcagccactaacatagtgaaggactacagatacacatacgataagtacttcctgcacatgcctattacaattaactttaaagcaaataaaacagggtttattaacgacagaatcttacagtatattgccaaagaaaaggatctgcatgtgataggaatagacagaggagaaagaaacctgatatacgtctccgtgattgatacatgtgggaacatagtagaacagaagtcctttaacattgttaatgggtacgattatcaaattaaattaaaacaacaagaaggagcacgtcaaatagctaggaaagaatggaaagagataggaaaaattaaggaaattaaggagggttacctgtcccttgtaattcatgaaatatccaaaatggtaattaaatataacgcgatcatcgcgatggaagatctaagctacgggttcaaaaaaggcaggtttaaggtggagaggcaagtttaccaaaagttcgagacaatgttgattaataagttaaactacttagttttcaaagatatctccataaccgagaatggcgggcttttaaaagggtaccaactaacatatatcccggataaattgaagaacgttggacaccagtgtggctgcatattttatgtacccgctgcgtatacttctaaaattgacccgaccaccgggtttgtaaacatattcaagtttaaggacctaacagttgacgccaaacgtgagttcatcaagaagttcgatagtataaggtatgactctgagaagaaccttttctgcttcacgtttgactataataatttcatcacccaaaatacagttatgtcaaaaagctcttggtcagtatatacgtatggcgtaaggattaagcgtaggttcgtgaacggtagattttccaacgagtcagatactattgatattaccaaggatatggagaagacattagaaatgacagatataaattggagggatgggcacgatctaaggcaagatatcattgattacgaaattgttcagcacatattcgagatattccgtcttacagtacaaatgcgtaacagcttgtctgagttggaagatcgtgactatgacaggttgatatcaccggtcttgaacgagaacaatatattctacgacagcgctaaggcgggagacgctctgcctaaagacgcagatgccaatggggcgtactgcattgccttaaaaggcttatacgagattaaacagatcacagagaactggaaagaggacggcaagttttctagagataaattgaaaatctcaaacaaagactggttcgatttcatccaaaacaaaagataccttaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 80 - DNA, 3963 bp, Artificial Sequence
  Description of Artificial Sequence: Synthetic polynucleotide
agcccagcggctaaaaaaaagaaactggatggcagcgtggatatgaacaatggaactaacaacttccagaactttatcggcatctcttccctccaaaagacactgagaaatgcactgatcccaaccgaaacgactcaacaatttattgttaagaacggcatcataaaagaagacgagcttcgcggcgagaaccgccagatacttaaggatattatggacgattattaccgaggctttatcagcgaaactcttagctctattgatgatatcgactggacctccctcttcgaaaaaatggagatacagctcaagaacggcgataataaagacaccttgataaaggaacagactgagtacaggaaagcgatccacaagaaattcgcgaacgacgacaggtttaaaaacatgttctctgcaaaattgatatccgacatcttgccggaatttgtgatacacaacaataactatagcgcttcagagaaagaagagaagacccaagtaatcaagttgttcagccgcttcgcaacgtcttttaaagattactttaagaaccgggccaattgtttctccgcggatgatattagctcatcaagttgccatcgaattgtcaatgataatgcggagatcttcttcagcaatgcgctggtctacagacgaatcgtaaaaagtctttcaaatgacgacatcaataagattagtggagatatgaaggattcccttaaggaaatgagtcttgaagaaatatactcatacgaaaagtacggggaatttattacccaggaggggatctccttctataacgacatctgtggaaaagtaaactcattcatgaacctgtactgtcagaaaaacaaagaaaacaaaaatctgtataaactccaaaaattgcacaagcaaatattgtgtatagcggacacatcatacgaggttccatataagttcgaaagtgatgaagaagtctaccaatcagtgaatgggtttctggacaacattagttccaagcacatagttgaacgactgcgaaagattggtgacaattacaacggctataatttggacaagatttatatagttagcaaattttatgaatccgtatcacaaaagacttatagagactgggaaacaatcaacacggcacttgagatccattataacaatattcttccagggaacggcaaaagcaaggctgataaggtaaaaaaggccgttaagaatgatcttcaaaaatccataacggagatcaacgaacttgtaagtaactacaaattgtgctctgacgacaatataaaggctgaaacgtatattcacgagattagccatatcctgaataactttgaggcccaagaactcaagtataacccggaaatacatttggtagaaagcgagcttaaagcgagtgagctgaaaaacgtcctcgatgtgatcatgaatgctttccactggtgtagtgtctttatgactgaggagttggttgataaagacaataatttctacgctgaactggaagaaatttacgacgaaatctatccagtgatctccctctataacctcgttcgaaactacgtgacgcagaaaccttattctacaaagaaaattaagttgaacttcggcattcctacacttgctgacggatggtccaaatccaaagagtactcaaacaacgcaatcatcctcatgcgggataacctttattatttgggcattttcaacgccaaaaacaaacctgataaaaagataattgaaggcaatacgagtgagaacaagggcgactacaaaaaaatgatatataacttgttgccaggccccaacaagatgattcctaaagtttttctgtcttctaagactggagttgaaacttacaaaccctccgcctacattcttgaagggtataaacagaataagcacataaagtcctcaaaggatttcgacattacgttttgccatgacctcatcgactatttcaagaactgtatcgccatacatccggagtggaagaattttggatttgatttctccgacacatctacctatgaagacataagcggtttctaccgggaggtcgagcttcagggctataagatagattggacatacattagtgaaaaagatatcgatcttctgcaagaaaagggacaactttacctttttcagatttataataaagacttttcaaaaaagtccacagggaacgataatctgcacaccatgtatctcaagaatctgtttagtgaagaaaaccttaaagacatagttttgaagcttaacggagaggctgagattttttttagaaagtcctcaattaaaaaccctataatacacaagaaaggctctattcttgttaacaggacatatgaagccgaggagaaagatcagtttggcaatatccagattgttcgcaagaatatcccggaaaatatatatcaggagctgtataaatactttaacgacaagagcgacaaggagctgagtgacgaggccgcgaagcttaagaatgtagtaggtcaccacgaagcagccaccaatatcgtcaaagactataggtacacgtacgacaagtactttttgcacatgcctataactataaacttcaaagctaataaaactgggtttattaatgacaggattctccaatacatcgctaaagagaaggatctgcatgtaattggcatagacagaggtgagagaaacttgatatatgtcagcgtaatagacacatgtggcaatatcgtggaacagaagtcttttaacatcgtcaatggttacgactaccaaattaagttgaaacagcaggaaggcgcacgacagatcgcacgaaaggaatggaaagagataggcaaaataaaagaaataaaggagggctatctcagtctcgttatacacgaaatttcaaaaatggttattaagtacaatgcaatcatagcgatggaggatctcagttatgggttcaaaaagggtcggtttaaagttgagcgccaagtgtaccaaaagttcgagacaatgctgattaacaagctgaactacctcgtcttcaaagatataagtattacggagaacggtggccttcttaaaggctatcaacttacttacatcccggacaagctcaaaaacgtagggcaccaatgcgggtgtattttctatgtgcctgcggcatatacgtcaaagattgacccaaccacaggattcgtaaacatattcaagtttaaggacctcaccgttgatgcgaaaagggagttcattaaaaaatttgattctattcgatatgatagtgagaaaaatctcttttgtttcacatttgactataataattttattactcagaatactgtcatgagcaagtcatcttggtcagtgtacacatacggggtgcggatcaaacgcaggttcgtcaatggtcgcttctcaaacgaatcagacaccattgacatcacaaaggacatggaaaaaacccttgagatgaccgacattaattggcgcgatggtcatgatctgcggcaagacatcatagactacgaaatcgtccaacacatctttgagatctttcgcttgacggtccaaatgcggaactccctgtccgagctcgaggatagagattatgatcggctgatatctcccgtgcttaatgaaaataacatcttctacgactccgccaaggcgggtgatgccctgccgaaggatgcggatgctaatggcgcttattgcattgctcttaaggggctctatgagataaagcagatcacggaaaactggaaagaagacggtaagtttagtagagacaagctgaagatctcaaataaagactggtttgatttcatacagaacaagcggtacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 81 - DNA, 3963 bp, Artificial Sequence
  Description of Artificial Sequence: Synthetic polynucleotide
agcccagcggctaaaaaaaagaaactggatggcagcgtggatatgaacaatggcactaacaattttcagaatttcatcggcatttcaagtctgcaaaaaactctgaggaatgctttgatccctactgaaaccactcagcaatttatagtcaagaacggtataattaaagaagatgaactcaggggtgaaaatagacaaatactcaaggacattatggatgactattatagaggcttcatctcagagactctctcatcaatagatgatatcgattggactagccttttcgagaaaatggagattcagttgaaaaatggtgataacaaagatacgttgataaaggaacagaccgagtacaggaaagccattcataagaaatttgctaatgacgatagatttaagaatatgtttagtgcaaaactgattagtgacattctgccggagttcgttatccataataataactactctgcatccgaaaaggaggaaaagacgcaagttattaaactgttcagccgcttcgccacaagcttcaaggactacttcaaaaatagagccaactgcttttctgccgacgatatatcatcatcttcatgccatcggatcgttaacgataacgccgagatattcttcagcaacgcccttgtatatcgaagaatagtcaaaagtctgagtaatgatgatattaataaaattagcggtgatatgaaagactccctgaaggaaatgtcactggaggaaatttatagttacgaaaagtacggcgaattcattactcaagaaggcatatccttctataacgacatttgcggaaaggtcaactcattcatgaacctttattgccagaagaataaggagaataaaaatctttacaaattgcaaaaacttcacaaacaaattctttgcatcgcggatacgtcctacgaagttccttacaaatttgaatccgatgaggaagtgtatcagagtgtcaatggatttttggataatatctcttcaaaacatattgtggagagattgcgcaaaataggtgataactacaatggctacaacctggacaagatttatattgttagcaagttctatgaaagtgtcagtcaaaagacctacagagattgggagacaatcaacacggcgctcgaaatacactacaataacatcctccccggcaatgggaagagtaaagccgataaggttaaaaaagctgttaagaacgacctccagaaatccatcacggaaataaacgagctggtttccaactataagctgtgtagcgatgataatattaaggctgagacatatatacatgagatcagccacattctcaacaatttcgaggcacaggaactcaaatacaatcccgagattcacttggtggaaagtgagttgaaggcgtcagagcttaagaatgtacttgacgtaataatgaatgcttttcattggtgctccgtgttcatgactgaggaactcgtggataaggataataacttttatgcggagttggaagagatatacgatgaaatatacccggttatctcactgtataatctggtcagaaattacgtgacccaaaagccttatagtacaaaaaaaataaagttgaacttcggtattccgacattggcagatggttggtccaaaagcaaagaatactctaataacgccattatattgatgcgagacaatttgtattaccttgggatctttaacgcgaaaaacaaaccggataagaagatcatcgaaggtaatacatctgagaataagggggattacaagaagatgatttataatctgttgccggggccaaacaagatgattccgaaggtctttctgtcatctaagacaggagtagagacctacaaaccttctgcgtacattttggaaggctacaaacagaacaagcatataaaatctagcaaggactttgatatcacgttttgtcatgatctgatagattatttcaaaaactgcatcgctatacatcctgagtggaagaatttcggctttgacttttctgacaccagcacatacgaagacatctcaggtttctaccgggaagtcgagctccaggggtacaagattgactggacatatataagtgaaaaagacatcgacctcctccaagagaagggccaactttacctgttccagatctataacaaagacttttctaaaaagtccacgggtaacgacaacttgcacactatgtatctgaaaaacttgttctctgaagagaacctcaaggacatcgtcctgaagcttaacggggaggcggagatcttctttagaaagtcctctatcaaaaatcccattatccataaaaagggctctatactcgttaataggacatatgaagcggaggaaaaagatcaatttgggaacatccagatcgtccggaaaaatatacctgagaatatctatcaagagctgtacaagtattttaatgataagtcagacaaagagctcagtgatgaggcggcaaagctcaagaacgtggtggggcatcatgaagctgcgacgaacattgtcaaagattatagatacacttacgataaatacttcctccacatgccgataacgattaacttcaaagccaataagacggggtttataaatgatcggatccttcagtacattgcgaaagagaaagacctccatgtgatcggaattgaccgaggagaaaggaatctgatttacgtgtccgtgattgatacttgcgggaatatagtcgagcaaaagagtttcaacatagtcaacgggtatgactatcagataaagctcaaacagcaggaaggtgcgaggcaaattgcgcgcaaagagtggaaggagataggcaagattaaagaaatcaaggaaggttatctcagcttggtgatccatgaaatatctaagatggttataaagtacaatgccataatagccatggaggatctttcctacgggtttaagaagggccgatttaaagtggagcgacaagtttaccagaagttcgaaaccatgttgattaacaaacttaactatttggtgttcaaggatataagtataaccgaaaacggcggtttgcttaagggttatcagctcacgtatattcctgataaacttaaaaacgttggacaccagtgtggatgtatcttctacgtgccagccgcttacactagtaagatagatcctaccacggggtttgtgaatatttttaagtttaaagacttgacagtcgacgccaaaagggaatttataaaaaagtttgattctatccgctacgatagtgaaaaaaatctcttttgctttactttcgactataacaacttcattacgcagaacactgtcatgagtaagtccagctggagcgtctacacatatggcgtccgaattaaacgacgatttgtaaacgggcggttttcaaacgaatctgacacgatagacattaccaaggatatggagaagacacttgagatgaccgacataaactggcgggacggtcacgatcttcggcaggacataattgattacgaaatcgtccagcatatattcgaaatatttcgacttacagtgcaaatgcggaacagtctctctgaactggaagatcgcgattatgaccggttgatttctccggtcctcaatgaaaataacatattttatgatagtgctaaggcaggtgatgcgttgccaaaggatgcagacgctaatggtgcctattgtatcgcgctcaagggattgtacgagataaagcaaattacggagaactggaaggaggatggtaagtttagccgagacaagttgaagattagcaataaagactggtttgattttatccaaaacaagaggtacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 82 - DNA, 3963 bp, Artificial Sequence
  Description of Artificial Sequence: Synthetic polynucleotide
agcccagcggctaaaaaaaagaaactggatggcagcgtggatatgaataacggaactaataactttcaaaatttcataggtatttcaagcttgcagaagaccctgaggaatgccctgattccaaccgagacaacgcagcagttcatagtcaaaaatggcattattaaggaagatgagctgcggggggaaaaccgacagatactcaaggatattatggacgactattaccggggatttatctcagaaacgctgagcagtattgatgacatcgattggaccagtcttttcgagaaaatggaaattcaacttaagaatggtgacaataaagacactctcataaaggagcaaactgaataccgaaaagccatacacaaaaagtttgccaacgatgaccgctttaaaaacatgttttcagctaagctcattagcgacattctccccgagtttgtgattcataacaataactatagcgcatccgagaaggaggaaaaaacccaagttatcaaattgttcagtagattcgctacgagctttaaagattactttaaaaaccgggctaactgcttcagtgcagacgatatcagctcctcatcctgtcatcgcatcgtcaatgataatgctgagatcttcttttctaatgcactggtttaccgcaggatagttaagtctcttagtaacgacgacatcaacaagatatcaggagatatgaaggattcccttaaagaaatgagtctcgaggagatatattcttatgaaaaatacggcgaatttattacccaagagggcattagtttctataatgacatatgcggaaaagttaatagttttatgaatctctattgtcagaagaataaggagaataagaacctctacaaattgcagaagttgcacaagcaaattctgtgtatcgcggacacctcttacgaggtcccatataagttcgagagtgatgaagaagtataccagagcgttaatgggttcctggacaacatctcaagtaaacacatagtcgaaaggctccgaaagatcggtgataactataacggatataatttggataaaatttatatagttagcaaattttacgagagcgtcagtcagaagacctaccgggactgggagaccataaacacagcgctggaaatacattataacaacatactgcctgggaacggtaagtcaaaggcagacaaggttaaaaaggctgtgaagaatgacctgcaaaaatcaattacagaaataaatgagttggtaagtaattacaaactttgcagcgatgataatataaaggcagagacgtacatacatgaaatatctcatatcctcaacaatttcgaagcccaagaactgaagtacaacccggaaattcatcttgtagagtctgagttgaaggcctccgaattgaaaaacgttcttgacgtaattatgaatgccttccactggtgctcagtattcatgacggaagagctcgtggataaagacaacaatttttacgctgaactggaagaaatatatgacgagatttaccccgtaatttcactctacaacttggtacgaaattacgttacccaaaagccatactcaacaaaaaaaattaaactgaacttcgggatacccaccctcgcagatggatggtcaaagtccaaagagtacagtaacaatgcaattatcctgatgcgagacaacctttattacctcgggattttcaacgctaaaaataaacctgataaaaaaataattgagggtaatacctctgaaaacaagggggattataaaaagatgatatacaatctgctgcctggcccgaacaaaatgattcctaaagtcttcttgtcttccaagactggagtcgaaacctacaagccaagtgcttatatactcgaagggtacaaacaaaataagcacataaaatccagcaaggattttgatattacattctgccacgatttgattgattattttaagaactgtatagccatccacccagaatggaagaattttggttttgattttagcgatacctcaacatatgaggatatctctggcttttaccgcgaggtagaactgcaaggttataagatcgattggacttatatttctgaaaaggacatagatctcctgcaagagaaagggcaactttatttgtttcaaatatacaacaaagattttagtaagaagagtactggcaatgataaccttcacactatgtatctgaagaaccttttttctgaggagaacttgaaggacatagtccttaaactcaatggggaagctgaaatattctttcgcaaaagctccattaaaaacccgatcattcataaaaagggttccatcttggtaaaccgcacatacgaggcggaagaaaaagatcagttcggaaatatccagatcgtaaggaagaatatccccgaaaatatataccaagagctttacaaatattttaacgataagtcagacaaggaactgtcagacgaagcagccaagttgaagaatgtcgtagggcaccacgaagcagctacaaacatagttaaagattatcggtacacctacgataaatatttcctgcatatgccaataaccataaacttcaaagccaacaaaacagggttcatcaatgaccgaatacttcagtatatagccaaggaaaaagacctgcatgttataggaatagatagaggtgagcgcaacttgatatatgtcagcgtgatagacacctgcggaaatatcgtcgagcaaaaaagtttcaacattgttaatggctacgattaccaaattaaattgaagcagcaagagggggctcggcaaatcgcgcgaaaggaatggaaagaaatcgggaagattaaagaaattaaagagggctacctgtctcttgtaattcacgaaatatctaagatggtcatcaagtataatgccattattgcgatggaagatctgtcctacggatttaagaaaggcaggtttaaagtcgaaaggcaggtgtaccagaaattcgagaccatgctgattaataagctcaactatctcgtatttaaggatatttctataactgaaaatggagggcttctcaaaggatatcaactcacatacatacctgataagctgaagaacgtaggccaccagtgtggatgcatattctatgtaccagctgcatacacaagcaagatcgatccaactactgggtttgtcaatatcttcaaatttaaggacttgacggtcgatgccaaacgggagttcatcaaaaagtttgatagtattcgatatgatagtgagaagaacttgttttgcttcacatttgactacaacaatttcataacgcaaaatacggttatgtctaaatcctcatggagcgtctacacttacggagtgaggataaagcggcgcttcgtaaatggcaggtttagcaatgaatccgacacgattgacataaccaaggatatggagaaaaccctcgagatgaccgatataaattggcgggatggacacgatctgcgacaagacataatcgattatgaaatcgtgcagcacatatttgagatattcaggcttacggtccaaatgagaaattccctttccgaacttgaagaccgcgattacgaccgactgataagccccgttctgaacgaaaataacatcttctacgacagcgctaaagcgggagacgcgctgccgaaagatgcggacgcaaatggagcctattgtatcgccttgaaagggttgtacgagatcaaacagataaccgagaattggaaggaggatgggaagtttagtcgagacaaacttaaaataagcaacaaggactggttcgactttattcaaaacaaacgatatctcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 83 - DNA, 3963 bp, Artificial Sequence
  Description of Artificial Sequence: Synthetic polynucleotide
agcccagcggctaaaaaaaagaaactggatggcagcgtggatatgaataatggtactaacaattttcaaaactttatcggcatctcttcacttcagaaaactcttcggaacgcccttataccgacggagacaacgcagcagtttatagttaaaaacgggatcattaaagaagatgaactcagaggggaaaacaggcaaatattgaaggacattatggacgattactaccgggggtttatttcagagaccctttcatctattgatgacatagattggacctcccttttcgagaaaatggagatacaattgaaaaacggcgacaataaagatacacttatcaaggaacaaactgagtatcgcaaggcgattcacaagaagtttgcgaatgacgatcgctttaagaatatgttttctgcgaagctcataagtgacattctgcctgaatttgtcattcataacaacaattattctgctagcgaaaaagaggaaaaaactcaagtcattaagctttttagcaggttcgctactagttttaaagactattttaagaaccgggcgaattgctttagcgctgacgacatatcatcctcatcctgtcatcgcatagtcaatgataatgcagaaatattcttttctaatgcgctcgtgtatcggagaatagtgaaaagcctctctaacgatgacattaacaaaataagcggcgatatgaaggatagtctgaaggaaatgtccctcgaagaaatatactcatacgagaagtacggagaatttatcacccaggaaggaattagtttttacaacgacatctgtggtaaggttaactcttttatgaatctgtattgtcaaaagaataaagaaaataaaaatctttataagctccaaaagcttcacaaacaaatcttgtgcattgcggatacgtcatacgaagtaccttacaaatttgaaagcgacgaagaggtgtatcagtcagtgaatgggttccttgacaatatttctagcaaacatattgtggagcgacttcgaaagatcggtgataattacaatggctataatttggataaaatttacatagttagtaagttttatgaatccgtctcacaaaagacgtaccgagattgggagaccatcaacactgctctggagattcattacaataatatattgcctgggaatgggaagtcaaaggccgacaaggttaaaaaagccgtaaaaaacgatcttcaaaagtccattaccgagataaatgaacttgtatccaactataagttgtgctctgacgataatattaaagcagaaacgtatatccacgaaataagtcacatcctgaacaacttcgaagctcaagagctcaagtataatcctgaaattcatctcgtcgaaagcgagctgaaagcatccgagttgaagaatgtgcttgatgtgatcatgaacgcattccattggtgcagtgtgttcatgaccgaagaacttgtagacaaagacaacaacttctacgctgaattggaagagatttacgatgaaatttaccccgtgatatccctctataatctggtaagaaattacgtcacgcaaaaaccatacagtaccaagaaaataaagctcaactttggtattccgacgttggcagatgggtggagtaagagcaaggagtattctaacaatgcaatcatcctcatgcgcgacaatttgtattatctggggatcttcaacgcgaaaaataagcccgacaaaaagataatagaaggcaatacgtccgagaacaaaggggactataagaaaatgatttataaccttcttccaggacccaacaagatgatcccaaaggttttcttgagttcaaaaaccggcgtagaaacttataaaccgtccgcctacattctggaagggtacaagcaaaacaagcacattaagtcatctaaggatttcgacattactttttgtcatgatttgatagactacttcaaaaattgtatagcgatacatccggaatggaaaaattttgggttcgatttttccgacacaagtacttatgaagacatctcagggttttatagggaagttgaactgcaaggttacaaaatagactggacttatattagtgagaaggacattgatttgctccaggaaaagggtcaattgtatctgttccagatatataacaaggatttctctaaaaaatctacaggtaacgacaatctccacacgatgtacctcaagaatctcttcagcgaagagaatttgaaggatatcgtacttaagctcaatggagaagcggaaatattcttcagaaagtccagcattaagaatcctataattcacaagaaagggtcaattctcgtaaaccggacttatgaggccgaagaaaaagatcagtttggtaacattcagattgtacggaaaaacattcccgagaacatctatcaagaactgtataaatactttaatgataaatccgacaaggaactttctgacgaggctgcaaaattgaagaacgtagtgggacaccatgaggccgcaaccaatatagtaaaggattacagatacacttatgataagtatttcctccatatgccgatcacgattaatttcaaggcgaataaaaccggcttcattaacgatcgcattttgcaatatattgcgaaggaaaaggatttgcacgtgataggtatagaccggggtgaacgaaacttgatttacgtctctgtgatcgacacatgcggaaatatagttgaacagaagtcctttaatattgtgaatggttacgactaccagataaaattgaagcaacaggagggcgcaagacagatagctcgcaaagagtggaaggaaatcggcaagatcaaagaaataaaggagggttatctttccctggtaattcatgaaattagcaagatggttattaagtataatgctataatagctatggaggacctttcctatgggttcaagaaaggtcgcttcaaagtggagcgacaagtgtatcaaaagttcgagactatgttgataaataaattgaattatttggtttttaaagacatttcaataactgagaacgggggtctcttgaaggggtaccaattgacttatattccggacaagttgaagaatgtcggacaccagtgtggttgcattttctacgtgcctgccgcttacacctcaaaaatcgatccgaccactggttttgtaaatatatttaaattcaaagatctcaccgttgatgccaaacgggagtttatcaaaaaattcgattccattcgctacgactctgagaaaaaccttttttgtttcacgttcgattataacaactttataacccaaaatactgtaatgtccaagtcaagttggtctgtctatacttacggagtaaggatcaagcgccgcttcgttaatgggagattctcaaacgagtctgataccatagacataactaaagacatggaaaaaaccctggaaatgacggacatcaattggcgagacgggcatgatcttcgacaggacataatagattacgaaattgttcaacacattttcgagatatttcgacttacggttcagatgaggaattccctttccgaattggaagaccgggattatgatcgacttatatctcccgtgctcaatgaaaacaatattttttatgattcagcgaaagctggggacgcgctgccaaaagatgccgatgccaatggagcatactgtatcgccctgaagggtttgtatgagattaagcaaattactgaaaactggaaggaagatggcaagttttctagagataagcttaagattagcaataaggactggtttgacttcattcaaaataaaaggtatcttaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 84 - DNA, 3963 bp, Artificial Sequence
  Description of Artificial Sequence: Synthetic polynucleotide
agcccagcggctaaaaaaaagaaactggatggcagcgtggatatgaataatggaacaaataattttcaaaattttattggtatcagttcattgcaaaagactttgagaaatgctttgatcccgactgagaccacacagcagttcatcgtcaaaaatggcataatcaaggaagacgaacttaggggtgagaatagacaaatattgaaggacatcatggatgactattatagggggttcatttccgaaacgctcagtagtattgatgacattgactggactagtcttttcgagaaaatggaaattcagcttaagaacggggacaataaagacacgctgatcaaggagcaaacggaatataggaaggcgatccataaaaaattcgcgaatgatgatcggtttaaaaacatgtttagtgccaagttgatcagcgacatactgcccgaattcgtgatccacaacaataattacagcgcctccgaaaaggaggaaaaaactcaggtcattaaattgtttagccgattcgcaacgagtttcaaagattattttaagaaccgggccaactgtttttcagcggatgatattagctccagcagctgccatcgcatagtaaatgataacgctgaaatcttttttagcaacgcacttgtctaccggaggattgtaaaatcactgtcaaatgatgacattaacaaaatatctggagatatgaaggactcactcaaagaaatgagcctggaagaaatatattcatacgaaaaatacggggagtttattacccaggaaggtatcagtttttataatgatatatgtggaaaagttaattcatttatgaatctttactgtcaaaaaaataaggagaacaagaatttgtacaagctccaaaaacttcataaacagattctgtgcatcgcagacacaagttatgaggtaccgtacaaatttgagagcgacgaagaagtttatcagagtgtgaatggtttcctggacaatatctcttctaaacacattgttgagaggcttaggaagatcggtgataattataacggctataatctggacaaaatttatattgtatcaaagttttatgaatcagtctctcaaaagacgtatcgggattgggaaacaattaacacggctctggagatccactacaataacattctgcccggcaacgggaagagcaaagctgataaggtcaagaaggcagtcaagaacgaccttcagaagagcataacagaaattaacgaattggtcagtaactacaaactgtgtagtgatgacaacataaaagccgaaacatacatccatgaaataagccatatcctgaataacttcgaagcccaagaacttaaatacaatcccgagattcatcttgtcgaatcagaactcaaggcgtccgagctcaaaaatgtccttgacgtgataatgaatgccttccactggtgcagcgtattcatgacggaggagttggtagataaagacaacaacttttatgccgaattggaagagatttatgatgagatttaccccgttatttctctgtacaacttggttcgaaactacgtaacacaaaaaccatactcaaccaaaaagatcaaactcaattttggcatacctacattggctgatggttggtccaagtcaaaggaatatagcaataatgcaataattctcatgcgagataacttgtattatttggggatctttaacgctaagaacaaaccagataaaaagataatcgaggggaacacaagtgagaacaagggtgattacaaaaaaatgatttacaatctgcttcctgggcctaacaaaatgattccgaaggtgtttcttagctctaaaactggagtggagacgtataagccttccgcgtacattctcgaaggctacaagcaaaataagcatatcaagtccagtaaggacttcgacatcactttttgccacgatctcatcgattactttaagaactgtatcgcaatacaccccgagtggaaaaactttggttttgatttttcagacactagtacctacgaggacatttccggcttctatcgagaagtcgaactccagggctacaaaatcgattggacgtacatttctgagaaggacatcgacttgctccaagagaaaggtcaactttacctcttccaaatttacaataaagacttttcaaagaagagcaccggtaatgacaacttgcataccatgtatctgaagaacctgttttctgaggagaacctcaaggatattgtattgaagttgaatggcgaagcagaaatatttttccgaaagtcatctatcaagaaccccattatacacaaaaaaggctctatcctggtgaaccggacttacgaggcagaggagaaggatcaattcggaaacatacagatagtccgcaaaaacatccctgagaatatctatcaggaactctataagtacttcaatgataaatcagacaaggagcttagcgacgaagcagctaaacttaaaaacgtggttggccatcacgaggccgctaccaacatagtcaaagactaccgctatacttatgacaagtactttttgcacatgcccataacaattaatttcaaagctaacaaaacagggtttataaatgacagaatcctccaatacatcgccaaagagaaggacctccatgtaatcgggattgatagaggcgaacggaacttgatttacgttagtgtcattgatacctgtggtaacattgtcgaacaaaagtcattcaacatagtcaatggatatgattatcagataaaactcaagcaacaagaaggcgcgaggcagattgccaggaaggaatggaaagaaatcgggaagatcaaggagatcaaggagggttacctgtccttggtgatacacgagatttcaaaaatggttataaaatacaatgccattatcgcgatggaggatttgtcttatggatttaagaaggggaggttcaaagtcgaacgacaagtctatcagaagtttgaaacaatgctcattaacaagctcaattaccttgttttcaaggatataagcatcactgaaaacggcggactccttaagggatatcagctgacttatatccccgacaagctcaagaacgtagggcaccaatgcggatgcatcttttacgtgcctgcagcatatacttcaaaaattgatccgactactggctttgttaacattttcaagttcaaggatctgacggtagacgctaagagagaattcataaaaaagtttgacagcatcaggtacgatagtgaaaagaaccttttttgttttacctttgactacaataattttattacgcaaaatacagttatgagcaaatcaagttggagcgtttacacatatggcgttcggatcaagcgcagattcgtcaatggtcgcttctcaaatgagagcgatacaatcgatataacgaaggatatggagaagacgcttgagatgacagatatcaactggcgggacggacatgaccttagacaagacataatcgattacgaaatagtacagcatatctttgagatttttaggcttacagttcagatgcggaactctctttccgaactggaggaccgggattatgatcggttgatctccccagtactgaacgaaaataatatcttttacgatagcgcgaaggctggtgatgcactcccaaaagacgctgatgcgaacggagcttattgcatagcccttaaagggctttacgagattaaacaaataacagaaaattggaaggaagatggcaaattttcccgcgacaagttgaagattagtaacaaagactggttcgacttcattcagaataaacgctacctcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 85 - DNA, 3960 bp, Artificial Sequence
  Description of Artificial Sequence: Synthetic polynucleotide
ccagcggctaaaaaaaagaaactggatggcagcgtggatatgaataacggtaccaataacttccagaacttcatcggtatttctagcctgcaaaagaccctgcgtaacgcgctgattccgaccgagactacccagcaattcatcgtgaaaaacggtatcattaaggaagatgaattgcgcggtgagaatcgtcagattctgaaagatatcatggatgactactatcgcggtttcattagcgaaaccctgtcgagcatcgatgatatcgattggacgagcctcttcgagaaaatggaaattcaactgaaaaatggtgacaacaaagataccctgattaaagaacaaacggaataccgcaaggcaatccataaaaagtttgcgaatgacgaccgttttaagaatatgttctcggccaagctgatttccgacatcctgccagagttcgtcattcacaacaacaattacagcgcaagcgagaaagaggaaaagactcaggtcattaagctgtttagccgctttgcgacgtccttcaaagactacttcaagaatcgtgcgaattgctttagcgcggatgacatctctagctctagctgtcaccgtattgttaacgacaatgcagagattttcttcagcaacgccctggtgtatcgccgtattgtcaagtctctgagcaacgacgacattaacaagatcagcggcgacatgaaagacagcctgaaagaaatgtctctggaagaaatctacagctacgagaaatatggtgagtttatcacccaagagggcattagcttctacaatgatatctgtggtaaggttaatagctttatgaatctgtactgccagaagaataaagaaaacaagaacttgtacaagctgcaaaagctgcataagcaaattctgtgcatcgccgatactagctatgaagttccgtacaagttcgagtctgatgaagaggtgtatcagtcagtcaacggttttctggataacatcagcagcaagcacatcgtcgagcgcctgcgcaagattggtgacaactacaatggttataacctggacaagatctatatcgtgtcgaagttttacgagagcgtgtcccagaaaacgtaccgtgattgggaaacgattaacacggccttggaaattcactataacaatatcctgccgggcaacggcaagagcaaagctgacaaagtcaaaaaagctgtgaaaaacgatctgcaaaagtccatcaccgagatcaacgaactggttagcaactataagctgtgtagcgacgacaacattaaagctgaaacgtatatccacgaaatcagccacatcctgaataactttgaggcacaagaactgaaatacaatcctgagatccatctggtagagagcgagctgaaggcaagcgagttgaaaaacgttctcgacgttatcatgaatgctttccactggtgtagcgtgtttatgaccgaagaactggttgacaaagataacaatttctatgcagagctggaagaaatctatgatgaaatctacccggtcatcagcctgtataacctggttcgtaactacgtgacgcagaagccgtacagcaccaaaaagatcaagctgaacttcggtattccgaccttggcggacggttggagcaaatccaaagaatactccaataatgcgattattctgatgcgtgataatctgtactatctgggtatcttcaatgcgaagaacaagccagataaaaagattattgaaggcaacaccagcgagaataaaggcgactacaagaaaatgatctacaacttattgccgggtccgaacaagatgatcccgaaagtttttctgagcagcaagaccggcgttgaaacctataagccgagcgcgtacattttagagggctataaacaaaacaagcacatcaagagcagcaaagattttgatattacgttctgccacgacctgatcgactatttcaagaattgtattgcgattcaccctgagtggaagaacttcggttttgacttttccgatacctccacctatgaagatattagcggtttttaccgtgaagtcgagttgcagggttataagattgattggacttacatttccgagaaagacatcgacctgttgcaagagaaaggtcagctgtacctgtttcagatctataacaaagatttcagcaaaaagtcgacgggcaatgataatctgcacaccatgtatctgaaaaacctgtttagcgaagagaacctgaaagacattgttcttaagctgaatggtgaggccgagatcttcttccgtaaaagctccattaagaacccgattatccacaaaaagggctctattctggttaaccgcacgtacgaagcggaagagaaagatcaatttggtaacatccagatcgtgcgtaagaatatcccggagaacatttaccaagaactgtataagtatttcaatgacaagagcgataaagaattgagcgatgaagcggcaaagctgaaaaacgtcgttggccaccacgaagccgcgacgaatatcgtgaaagattatcgttacacctacgacaagtactttctgcacatgccgatcaccatcaatttcaaagcgaataaaacgggttttatcaatgaccgtatcctgcagtacattgcgaaagaaaaagatttacacgtgattggtattgatcgcggcgagcgcaatctgatttacgtcagcgttatcgacacgtgcggcaatattgtggagcagaaaagcttcaatatcgtcaatggttacgactaccagatcaaactgaagcaacaagagggcgcccgccagattgcgcgtaaagagtggaaagaaatcggtaagattaaagaaatcaaggaaggctacctgtccctggtgatccatgaaatcagcaaaatggtgatcaagtacaacgctatcattgcgatggaagatctgagctacggttttaaaaagggtcgcttcaaagttgagcgtcaagtgtatcagaaatttgagactatgctgattaacaagttgaactatctggtttttaaagacatcagcattaccgagaatggtggcctgctgaagggttatcaactgacctatattcctgacaagttgaaaaatgttggtcatcagtgtggttgcattttctacgtaccggcagcgtacacgagcaagattgacccgaccacgggtttcgttaacattttcaagtttaaagatttgaccgtggacgccaagcgtgagttcattaaaaagttcgacagcatcagatacgactctgagaagaatctgttctgctttacgttcgactacaataacttcattacccaaaataccgttatgagcaaaagctcctggagcgtgtacacgtacggcgtccgtatcaagcgtcgttttgtgaatggtcgcttttccaacgaatctgacaccattgacattaccaaagatatggaaaagacccttgagatgaccgacattaattggcgtgatggccatgacttgcgccaagacattatcgactacgaaattgttcagcacatctttgagatttttcgtctgacggtccagatgcgcaactcgctgagcgagttggaagatcgtgactatgaccgtctgattagcccggtgctgaatgaaaacaatatcttctatgatagcgcaaaggccggtgacgcgctgccgaaagatgcggatgctaacggtgcatactgcattgcactgaagggtctgtacgaaatcaaacagatcaccgagaattggaaagaggatggtaagtttagccgtgataagctgaagattagcaataaagactggttcgactttattcaaaacaagcgctatctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 86 - DNA, 3960 bp, Artificial Sequence
  Description of Artificial Sequence: Synthetic polynucleotide
ccagcggctaaaaaaaagaaactggatggcagcgtggatatgaacaacggaacaaataattttcagaactttattgggatcagttcgcttcagaaaacgcttcgtaatgctctgattcccacagaaaccactcagcagtttatcgtaaagaatggcattatcaaggaggatgaattacgcggcgagaaccgccaaatcttaaaagatatcatggacgactactaccgcggtttcattagcgaaactcttagttcaattgacgacattgactggacgtccttgttcgaaaagatggagattcaattaaagaacggtgataacaaggatacgttgattaaagaacagacggagtaccgtaaggctatccacaaaaaatttgcaaacgacgaccgctttaaaaatatgtttagcgcaaaattaatctccgacatcctgcctgaattcgtcatccataacaataactatagcgcctcggaaaaagaagaaaaaacgcaggttattaaacttttctcgcgctttgcaacaagctttaaggattacttcaaaaatcgcgccaattgtttttcagccgacgacattagctccagttcctgccaccgtattgtgaatgacaacgctgagatttttttttccaatgcgctggtttatcgtcgtattgttaagagccttagtaacgacgacattaataaaattagcggtgatatgaaggatagcttgaaagaaatgagtctggaagagatctatagttacgagaagtacggcgaatttattacccaggagggcatttcattttacaatgatatctgtggaaaagtcaactcctttatgaacttgtattgccaaaagaataaagaaaacaaaaacctgtacaaactgcaaaagttacacaagcagattttgtgtatcgcagacacgtcatacgaagtaccgtacaagtttgagtccgatgaagaagtgtaccaaagcgttaatggctttttggataacatttcgagcaaacatatcgtagagcgtttgcgtaagattggtgataattacaacggttacaatttagacaaaatctatatcgtctctaagttttacgaaagtgtttctcagaaaacttaccgcgattgggagacgatcaacactgcgctggagattcattacaataatatccttccaggtaacggtaaaagcaaagctgataaggtgaaaaaggcggttaaaaatgaccttcaaaagtctatcacagaaatcaacgaattggtcagcaattataagctttgcagtgacgataacattaaggccgagacttacatccatgagatctctcacattcttaataattttgaagcgcaagagctgaaatacaatcctgaaatccatctggtcgaaagtgaattaaaagcctccgaattaaaaaatgtcttggacgtgatcatgaatgcgttccattggtgctcagtttttatgacggaagagttggtggacaaagacaacaatttttacgccgagcttgaggaaatttacgacgaaatttaccccgttatttcgttatacaaccttgtgcgtaattacgttacacaaaagccctattcgacaaagaaaatcaagttaaatttcgggattcccacattagctgatggatggtccaaatccaaagaatactcgaataacgctatcatccttatgcgtgataatttgtactacttaggcatcttcaatgcgaagaacaaacctgacaagaaaattatcgaaggaaacacttcggagaacaaaggtgattataaaaagatgatctacaacttgcttcccgggccaaacaaaatgattcccaaggtatttttgagttctaaaaccggtgtcgaaacttacaaaccaagtgcttatattttggaaggatacaaacagaacaaacatatcaagtcttcgaaagacttcgatattacgttctgccacgatctgatcgattacttcaagaactgtattgctattcaccccgagtggaagaactttggatttgatttctccgacacgtccacttatgaagatatctctggcttctatcgcgaggttgaattacaagggtataagattgactggacttatatttcggagaaggatatcgatcttttgcaagaaaaagggcaactttatttatttcagatctataacaaggacttttcaaaaaagagcactggaaatgacaatctgcataccatgtaccttaagaacctgttctcggaagagaacctgaaggacattgtacttaaactgaatggagaggcagagatcttctttcgcaaatcaagcattaagaacccaattattcacaaaaaggggagtatcttagtaaatcgcacatatgaggctgaggaaaaagatcagtttggtaacattcagatcgtgcgtaagaacattcctgaaaatatctatcaggaactttataagtatttcaacgataaaagtgataaagagctgagtgacgaagcggctaaacttaagaatgttgtgggacaccatgaggcagcaaccaatattgtgaaggattatcgctatacgtacgacaaatactttttacacatgcccatcactattaattttaaagctaataagactggcttcattaacgatcgcatcctgcagtacattgctaaggaaaaggatcttcacgttatcggtatcgatcgcggggagcgtaatcttatctacgtctctgtcattgacacgtgtggcaatattgtggagcaaaagtccttcaatattgttaacggctatgactatcagattaaattgaaacagcaggaaggtgcgcgtcagattgcccgcaaggaatggaaggaaattggcaagatcaaagaaattaaggagggctacttaagcttagtaattcacgaaattagtaaaatggttatcaaatacaacgccatcatcgcgatggaggatctttcgtacgggtttaagaaaggtcgttttaaagtggagcgtcaggtgtaccagaaatttgaaactatgcttattaacaaacttaactacctggttttcaaggatatcagtattactgaaaacggggggctgttaaaagggtatcaattaacttacattccagacaaattaaagaacgttggacatcagtgtggctgcattttttatgtaccagctgcatacacttcaaagatcgatcctacgactgggttcgtgaacatttttaagtttaaagacttgacggtagatgccaagcgcgaattcatcaagaaattcgacagcattcgctacgactctgagaaaaatcttttctgtttcacattcgattataacaatttcattacgcagaacacagtaatgtccaagtcttcttggagtgtttatacatatggtgtccgcattaagcgccgtttcgtcaacggccgcttcagtaatgagagcgatactattgacatcacaaaagacatggaaaaaacactggaaatgaccgacatcaattggcgtgacggccatgacttacgtcaggatatcattgattatgagatcgttcaacacatcttcgaaatctttcgcttgactgttcaaatgcgcaattccttgtcggaattggaggaccgtgattatgaccgcttaatttcccccgtcttaaatgaaaacaatattttttatgactctgcaaaagctggagatgctctgccgaaagacgccgatgcaaatggggcatattgcattgctttaaaggggctttacgagatcaagcaaatcaccgaaaactggaaagaggatggaaagttttcgcgtgataaactgaagatctctaacaaagactggttcgactttatccagaacaagcgttatttgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 87 - DNA, 3960 bp, Artificial Sequence
  Description of Artificial Sequence: Synthetic polynucleotide
ccagcggctaaaaaaaagaaactggatggcagcgtggatatgaacaacggcaccaataacttccaaaacttcatcgggatctctagccttcagaagacgcttcgcaatgctcttatcccaactgagaccactcaacaatttattgtgaagaatggaattattaaagaggacgaactgcgtggcgagaatcgtcagatcttaaaggacattatggatgattattaccgtggattcatctccgaaacattatcgtcgatcgatgatatcgattggacttctctgttcgagaaaatggaaattcaattgaaaaacggagataataaagatacgcttatcaaagaacagacggaatatcgtaaagcgattcataagaaattcgcaaatgacgatcgtttcaaaaatatgttcagtgccaagcttatttcggacattttacctgaatttgtaattcataataataactactcagcaagtgagaaggaggagaaaacccaagttattaaactgttctctcgtttcgcaacgtcctttaaagattactttaaaaaccgcgcgaattgctttagcgctgacgacatttccagctcatcctgtcatcgcatcgtaaacgacaatgcggaaatcttcttcagcaacgccctggtttaccgccgcatcgtcaaaagcttatcgaatgacgacatcaataagatctcaggagatatgaaggactcgcttaaggagatgtctctggaggaaatttatagttacgaaaagtatggagagttcattacccaggagggaatctcgttctacaatgacatttgcgggaaggtgaactccttcatgaacttatactgccagaaaaacaaagagaacaaaaatctgtataaattgcagaaattacataaacagattctttgtattgctgacacttcctacgaagtaccctataaattcgagtcagatgaagaagtataccagtccgtgaacggatttctggacaatatctcctcaaaacacatcgtggaacgcttacgtaaaattggcgataattataatggttacaatcttgacaaaatttatatcgtatctaaattttacgagagtgtgagccaaaagacctaccgcgactgggagaccatcaacacagctttagaaattcactataataatatcttacccggcaatggtaagagcaaggctgacaaggtaaaaaaggccgtcaagaatgatttgcagaaatctattacagaaattaatgagttagtctccaactataagctttgttccgacgataacatcaaagctgagacatatattcatgagattagtcacattcttaacaacttcgaggcccaggaacttaagtacaatcctgaaattcatcttgtcgagtctgagctgaaagctagtgaattgaaaaatgttttagacgttattatgaacgcattccactggtgctctgtgtttatgacagaagaactggtcgacaaggacaataacttctatgccgaacttgaggaaatctacgatgaaatttaccctgtaatctccttgtataatcttgtacgtaattacgtcactcaaaaaccttacagcacgaaaaaaattaaattgaacttcgggattcctacacttgccgacgggtggtctaaatccaaggaatatagcaacaatgccattattttaatgcgcgacaatctttactatttaggaatttttaacgctaagaacaagcccgataaaaagattattgaaggaaacacgtctgaaaataagggcgactacaaaaagatgatttataaccttttgcccggtccaaacaaaatgatcccaaaggtattcctgtcatccaaaacaggggttgagacatataagcccagcgcatatattctggaaggatacaaacagaataaacatatcaaaagcagcaaagattttgacattactttttgccacgatttaatcgactacttcaaaaactgtatcgctatccaccctgaatggaagaatttcggatttgatttctcagatacaagtacgtatgaggatatcagcggtttctatcgcgaagttgaacttcaagggtataaaattgactggacctacattagtgagaaggacatcgacctgttacaggaaaaaggccaattgtacttgtttcagatctacaataaggatttctcaaaaaaatcgaccggcaatgataacttgcacaccatgtacctgaagaaccttttttcggaggaaaaccttaaagacattgtcctgaagttgaatggagaagcggagattttctttcgtaagtcttccattaaaaatccaattattcataagaagggcagcatccttgtgaaccgtacgtacgaggcggaagagaaggaccaattcggtaacattcaaatcgtccgcaagaacatccctgaaaatatttatcaggagctttacaagtatttcaatgataagtccgacaaggaattatcagatgaggctgcgaagttgaaaaatgttgttggtcatcacgaggcggcgacgaatattgtaaaggattatcgctacacttatgacaagtactttctgcacatgccgatcaccattaatttcaaggcgaacaaaacaggatttattaatgaccgcatcttacaatacattgccaaagaaaaggacttacacgttattggcattgatcgtggagaacgcaacttaatctacgtaagcgttattgacacttgcgggaatatcgtagaacaaaagagcttcaacatcgtgaatggttacgattaccagatcaagcttaagcagcaggagggagcgcgccagatcgcgcgcaaggaatggaaggagattggtaagatcaaggaaatcaaggaaggttatctgtccttggtaatccacgaaatttcgaaaatggttatcaaatacaatgctattattgcaatggaggacttgtcctacggctttaaaaaaggacgctttaaggtggagcgccaggtttatcaaaagtttgaaacaatgctgattaacaagctgaactatttggtctttaaagatatctccatcaccgaaaatggtgggcttttgaaaggctatcaacttacatatatccctgataagcttaagaatgtgggtcatcagtgcgggtgcattttttatgttcctgcagcctacacgtccaaaatcgatcctacaactggatttgttaatatcttcaaatttaaggatcttaccgtcgacgcgaagcgcgaatttatcaagaaattcgatagtattcgttatgattccgaaaaaaaccttttctgtttcacctttgattataataactttatcacgcaaaatactgtcatgagcaaatcgagttggtctgtgtacacttacggagtacgcatcaagcgtcgttttgttaatgggcgcttcagtaacgagtcagacacgattgatatcacaaaagatatggagaaaacgctggagatgacagacatcaattggcgcgatggtcatgacttacgtcaagacattatcgattatgaaattgtccagcatatctttgagatctttcgtttgactgttcagatgcgcaacagcctgtcagaattggaggatcgtgactatgatcgccttatttctcccgtcttaaatgagaacaatatcttctacgactcagccaaggctggagatgcactgccaaaagacgccgacgcaaatggggcctactgtattgcattgaaggggttgtacgagatcaaacagattacagaaaattggaaggaggacggtaagttctctcgtgataagctgaagatttctaacaaagactggttcgatttcattcagaacaaacgttacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 88 - DNA, 3960 bp, Artificial Sequence
  Description of Artificial Sequence: Synthetic polynucleotide
ccagcggctaaaaaaaagaaactggatggcagcgtggatatgaacaacggtaccaataactttcagaatttcattggaatcagcagcttacagaaaaccctgcgcaatgcacttatccccactgagacaacccagcagttcattgtaaagaacgggattattaaagaagatgagcttcgcggggagaatcgtcagatcttaaaggatattatggacgattactaccgtggcttcatttcggagacgctgtcgtcgatcgacgacatcgactggacatccttgtttgaaaagatggaaatccaactgaagaatggcgataacaaggacacgttaatcaaagagcagacggaataccgtaaagctatccacaaaaagttcgctaatgacgaccgctttaagaacatgttctcagcaaaacttattagcgatattttacctgaatttgtcatccacaataacaattactccgcgagtgaaaaagaggagaaaacccaggtgattaagctgttttcccgttttgcaaccagtttcaaggactattttaagaatcgtgctaattgtttctctgcagacgacatttcctcgtcgtcctgccatcgcattgttaatgataatgctgaaatctttttttcaaacgcacttgtgtatcgtcgcattgtcaaaagcttaagtaatgacgatatcaataagatctcaggagacatgaaggactccctgaaagaaatgtcattggaagaaatttactcttatgaaaagtatggagaatttattacgcaggagggtatcagcttctataacgacatttgtggtaaagtgaacagctttatgaatctttattgtcaaaagaataaagagaacaaaaatctgtacaagctgcagaaattgcataaacaaattctgtgcattgcagatacttcgtatgaggttccttacaaattcgagtcggatgaggaggtgtatcaaagcgtaaacggatttttggataacattagtagtaagcatattgtggaacgccttcgcaagattggtgacaactataacggatacaacttagacaagatctatattgtctcgaagttttacgaaagtgtttcccaaaagacttatcgcgactgggagacaatcaacactgcgctggaaattcactataacaatatcttgccggggaacggaaaaagtaaggcagataaggtgaagaaagcagtcaaaaatgatctgcaaaaaagcattactgaaattaacgaacttgtgtcaaattacaaattgtgttcggatgacaatattaaagcggaaacgtatatccacgagatctcgcacattcttaataatttcgaggcgcaggaattaaagtataatcctgagatccatttggtggaatcagaacttaaagctagtgaactgaaaaatgtcctggacgttattatgaatgcatttcactggtgttctgtctttatgacagaagaacttgtcgacaaagacaacaacttttatgcggaattagaagagatttacgacgaaatttatcccgttatttcgttatataatttagttcgtaattacgtgactcagaaaccctacagcacaaaaaagattaaattaaactttgggattccgactcttgctgatggatggagcaagtccaaggagtactctaataacgccattatcttgatgcgtgacaacctgtactacctgggcatttttaacgctaaaaacaaacccgacaaaaagatcattgaagggaacacctcggaaaataagggggactataaaaaaatgatctacaatctgttgccaggcccaaataagatgatcccaaaggtttttttatcttccaaaactggcgtagaaacttacaagccgagcgcatacatccttgaaggatataaacaaaacaaacatatcaaaagttcaaaggacttcgatattacgttctgccatgatttaatcgattatttcaagaattgcatcgcgattcacccagagtggaaaaactttgggtttgatttttcagacaccagcacttacgaggatattagtggattctatcgtgaggttgaactgcagggctataaaattgactggacctatatttctgaaaaagatattgatctgcttcaggagaaaggccaattgtacttatttcaaatctataacaaggatttctccaagaagtccacgggtaatgacaacttacacacaatgtatctgaagaatctgtttagtgaggagaacttgaaggacattgtgctgaagcttaatggcgaggccgaaatcttttttcgtaagtcctccattaaaaaccctattatccataagaaagggagtattcttgtcaaccgcacgtatgaggccgaagaaaaggaccaattcggaaacatccaaattgtccgtaaaaatattcctgagaacatttaccaggagctttacaagtatttcaacgacaagagtgataaagaactttcagatgaggcggcgaaactgaagaatgtagtggggcaccacgaagctgccacgaatattgtaaaggattaccgttacacctacgacaagtactttttgcatatgcccatcacaattaattttaaggccaataaaactggttttatcaacgatcgtatcttacagtacattgctaaggaaaaagatctgcacgttatcggtatcgatcgcggggaacgcaatctgatttatgttagtgtgattgacacgtgcggaaatattgttgagcagaagagctttaatatcgtaaatggatatgactatcaaattaaactgaagcaacaggaaggggcccgccagattgcccgcaaggagtggaaagaaattggaaagatcaaggagattaaagaagggtacctttcccttgttatccacgaaatctcgaaaatggtgatcaagtacaatgccattattgctatggaggatctgtcatatgggtttaagaaaggccgctttaaggtggaacgtcaggtttaccagaagtttgagaccatgcttatcaataagctgaattatcttgtcttcaaagacatctcaatcacagagaacggcgggctgttaaaaggatatcagctgacctatatccccgacaaactgaaaaatgtcgggcaccaatgcggctgtattttctacgtgcccgctgcatacacatctaaaattgacccaacgactggattcgtaaatatttttaagtttaaggatcttacggtagatgcaaagcgcgaatttatcaagaaatttgatagtatccgttacgacagcgagaaaaacttattttgttttacgttcgattataacaacttcatcacgcaaaataccgtcatgtcaaaatcttcctggtcagtctatacgtatggcgtccgtatcaagcgccgcttcgtcaacgggcgtttttcaaacgagtcagataccatcgatatcaccaaagatatggaaaaaacattggagatgacggacatcaattggcgcgatggtcatgacttacgccaggacattattgactacgaaatcgtacaacatatttttgagattttccgtctgaccgtgcaaatgcgcaactcattatccgaacttgaggatcgtgattacgaccgcttgatcagtcctgttctgaacgagaataatattttttacgacagtgccaaggcgggagacgcactgcccaaggacgctgacgctaacggagcttattgtattgcgttgaagggactttacgaaatcaagcaaatcactgaaaactggaaggaggatggtaaattctcacgcgacaagttgaaaatttcgaacaaggactggttcgatttcatccaaaacaagcgttatttaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 89 - DNA, 3960 bp, Artificial Sequence
  Description of Artificial Sequence: Synthetic polynucleotide
ccagcggctaaaaaaaagaaactggatggcagcgtggatatgaacaacgggactaataacttccagaacttcatcggtatttcatcattacaaaaaacgcttcgtaacgccttgatcccaacagaaacgacccaacaatttattgtaaaaaacggcatcatcaaagaagacgaactgcgtggcgaaaatcgccaaattttgaaggacattatggatgactattatcgtgggtttatctcggagacattatcctccatcgacgacattgattggacgagtctttttgagaaaatggagatccagcttaaaaatggtgataacaaggatacattgatcaaggagcaaaccgagtaccgcaaggccatccataagaagttcgcaaatgacgaccgcttcaaaaatatgtttagtgccaaattgatctcggatatccttcctgagttcgtaattcacaacaataattatagcgcatccgaaaaggaggaaaagactcaagtcattaagcttttcagtcgctttgctacctcgtttaaggactatttcaagaaccgcgcgaactgcttctcagcggatgacatttcttcctcgtcgtgtcaccgcatcgtgaatgataatgcggagatcttctttagtaatgccttggtataccgccgcattgttaaatccctgtctaacgacgatatcaataagatctcaggagatatgaaggatagccttaaagaaatgtctctggaagaaatttactcctatgaaaagtacggtgagtttatcacccaagaggggattagcttttataacgatatctgcgggaaggtgaattcgtttatgaacctttattgtcaaaagaataaggagaataagaacttatataagcttcagaaactgcataaacaaatcttatgcattgccgatactagctatgaagttccgtataaattcgagagcgatgaagaagtttatcagagcgtcaatgggttcttggataacatttcatcaaaacacatcgtggaacgtctgcgtaagattggggataactacaacggatataatcttgacaaaatttatattgtatctaaattctatgagtcggtgagtcaaaagacctaccgtgattgggaaacaatcaataccgcgttagaaatccactataacaacattctgccagggaatggtaaaagtaaagcggacaaagtcaagaaggctgtgaagaacgatctgcaaaagagtattacagagattaacgaattagtctccaattataagttatgctcggacgataacattaaggcggagacgtatattcatgagatttcgcatattcttaacaacttcgaggcacaagagcttaagtataacccagagattcaccttgtcgaatcggagctgaaggcatcggaattaaaaaatgtcttagatgtaatcatgaacgcgttccattggtgcagtgttttcatgactgaggagttagttgacaaggacaataacttctacgcagaattagaagagatctatgatgagatttatccagtgatttcgctgtataatctggtacgtaattacgtcactcaaaagccctactcaacaaaaaaaattaagctgaacttcggaattccgactctggccgacgggtggtccaagtcaaaggagtattctaataatgctatcatcctgatgcgcgataacttatactatttgggaattttcaatgccaaaaataaaccagataaaaagattatcgaaggtaatacaagcgagaataagggtgactataagaaaatgatttacaatcttcttccaggccctaacaagatgattcccaaagtttttttgtccagtaaaacaggggtcgaaacttacaagcccagtgcctatatccttgaagggtacaagcagaataagcacatcaaatcctcgaaagactttgatattacattttgtcatgacttaatcgattattttaagaactgtatcgcaatccatccagaatggaagaacttcgggtttgatttctctgatacttccacgtatgaggatatttccgggttctaccgcgaagtagagcttcagggctataaaattgactggacatatatttcagaaaaagacatcgatctgttacaagaaaaaggacagttgtatctgtttcaaatctataataaggatttctccaaaaagtcaactggaaatgataacttacatacaatgtatctgaaaaatctttttagtgaagagaatttgaaggatatcgtgctgaagttaaatggcgaagcagagatcttcttccgcaagtcctcgatcaagaatcctatcatccacaagaaaggtagtattctggttaaccgcacgtacgaggccgaggaaaaagaccagttcggtaatatccagattgtacgtaagaatattcctgaaaatatttaccaggaattatacaagtattttaacgacaaatcggataaggagctttcagatgaggccgcaaagttgaagaacgtcgtaggacaccatgaggccgctacgaatatcgtcaaggactaccgctatacgtatgacaagtacttcctgcacatgcctattactatcaatttcaaagctaataaaacaggattcatcaatgatcgtatccttcagtacattgccaaagaaaaagatctgcacgtaatcggaatcgaccgtggcgaacgtaatctgatttacgtatcagttatcgacacatgtggtaacatcgtggagcagaaatcttttaacattgttaacggctatgattatcagattaagcttaaacagcaggagggggcacgccaaatcgctcgtaaagaatggaaggagattggaaagattaaagagattaaagaggggtacctttcgctggttattcacgaaatttccaagatggtgattaagtacaatgcaatcatcgcgatggaagatcttagttacggattcaaaaagggacgcttcaaagttgagcgtcaggtctaccagaaatttgaaacgatgctgattaacaaattgaattacttggtattcaaagatatctcaattactgaaaatggtggcttattaaagggttaccagcttacctatatcccggataagctgaagaacgtgggccatcaatgcggctgcatcttttacgtccctgccgcatatacctctaaaattgaccccaccaccggattcgtaaatatttttaaattcaaggacctgacggtggacgccaagcgcgaattcatcaaaaaattcgactcaatccgctatgattccgaaaaaaatcttttctgctttacgttcgattataataacttcattacccaaaacacggtgatgtcaaaatcgtcctggagcgtgtatacttatggagtgcgtatcaagcgccgctttgttaatgggcgcttcagtaacgaaagcgataccatcgacattaccaaagacatggagaagacgcttgaaatgacggatatcaattggcgtgacggacacgatcttcgtcaggatatcatcgactacgagattgtgcaacatatctttgagattttccgtttaactgttcaaatgcgtaactccttgtccgaattggaagaccgtgattacgaccgcttgatttcaccagtgcttaacgagaataacatcttctacgactccgccaaagcaggcgatgccctgccaaaggacgctgatgcaaatggtgcatactgtatcgcgttgaagggcttatacgagattaagcaaatcaccgaaaattggaaagaggatggaaagttcagtcgcgataagctgaagatctctaataaagattggtttgactttatccagaacaaacgttatttaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 90 - DNA, 3960 bp, Artificial Sequence
  Description of Artificial Sequence: Synthetic polynucleotide
ccagcggctaaaaaaaagaaactggatggcagcgtggatatgaacaacggtaccaataatttccaaaatttcatcggaatctcatccttgcaaaaaaccttgcgcaatgctttgatccccaccgaaaccacgcagcagttcatcgtgaaaaacggcattatcaaagaggatgagttgcgcggggaaaaccgtcaaattcttaaggatatcatggacgattactaccgtgggtttatcagtgagaccctgtcaagcattgacgacattgactggaccagcttatttgagaagatggagattcaattaaagaacggggacaataaggacacgcttatcaaagagcagacagaataccgtaaagcgattcataagaaatttgcaaatgacgatcgcttcaagaacatgttttcagcaaaattaatcagcgacatccttcccgaatttgtgattcataataacaactattcggctagcgaaaaagaggagaaaactcaggttattaagcttttctcgcgttttgccacttcgttcaaagactattttaagaatcgcgcaaactgcttttcggctgatgatatttccagttctagctgccatcgtatcgttaacgataatgctgagattttcttctctaatgccctggtgtatcgtcgtatcgttaaatctttgagcaacgacgatattaataagatttcaggcgacatgaaggattctttaaaggagatgtctttagaagagatttattcctatgagaaatatggcgagtttatcacccaagaaggaatttcgttctacaacgacatctgtggcaaagtgaacagcttcatgaatttatactgccaaaagaataaggagaataaaaatttatataaactgcagaaactgcataagcaaattctttgcattgcagacacctcttatgaagttccttataagtttgaatcggacgaggaggtatatcagagtgtgaacgggttcctggacaatatttcatccaagcatattgttgaacgtttacgcaaaattggagacaattacaatgggtataaccttgacaaaatttacatcgtgtcgaagttttacgaatcggtaagccagaagacctatcgtgactgggaaactatcaataccgccttagaaattcattacaacaatattcttcctggtaacggcaaaagcaaagccgataaggtaaagaaggctgtcaagaacgacctgcaaaagtctatcacagagatcaacgagttagtctctaactacaaattatgttccgacgacaatattaaagccgaaacctacatccatgagatctcacacattcttaacaattttgaggcccaggagctgaaatataacccagaaattcaccttgtagagagcgaattaaaagcctccgagctgaagaacgttttggatgtaatcatgaacgcatttcattggtgcagcgtatttatgacagaggagttggtcgacaaggacaataacttttacgccgagcttgaagaaatctacgatgaaatttacccggtaattagtttatataatttagttcgcaactacgtaactcagaaaccctacagtaccaagaagattaaattgaactttgggatcccgacacttgctgacggttggagtaaatcaaaagaatactccaataatgcaattatcctgatgcgcgacaatctttactacttggggatctttaacgcaaagaacaaaccagataagaaaatcatcgagggcaacaccagcgagaataaaggcgattacaagaaaatgatctataatcttttgccgggaccgaacaaaatgatcccaaaggttttcctgtcgtcgaaaacgggagtcgagacatataaaccatctgcgtacatcttggaaggttacaaacagaataagcatattaagtctagtaaagacttcgacatcaccttttgtcatgacctgattgattatttcaagaactgtattgctatccatccagaatggaaaaacttcggatttgacttctccgatactagcacctacgaagacatttcgggtttttatcgcgaagtagagcttcaagggtacaaaattgattggacatatattagcgagaaagacattgatttgcttcaagagaagggacagttatatttattccagatctacaacaaagacttctcgaagaaatccaccggtaatgataatcttcacactatgtacctgaagaatttattttcagaggaaaatctgaaggacattgtacttaaacttaatggagaagccgaaatcttcttccgcaagagttccattaaaaatccgattattcataaaaagggaagtatccttgtgaaccgcacgtatgaggccgaagagaaggatcagtttgggaatattcaaattgtccgcaaaaacatccccgagaacatctaccaggaactgtataaatactttaatgataaatctgataaagagttatcagacgaggctgccaaactgaaaaacgtagtcggtcatcatgaggcagcgaccaatattgtaaaggactaccgttacacctacgacaagtatttccttcacatgccgatcacgattaattttaaggctaacaagaccggctttatcaatgaccgcatcttgcagtacatcgcgaaagagaaagatttacacgtcatcggaattgatcgtggagagcgtaatcttatctacgtcagcgtcatcgacacctgtggaaacattgtggaacaaaaaagttttaatatcgtaaacggctacgactatcaaattaaacttaaacagcaagagggagctcgccagatcgctcgcaaagagtggaaagagattgggaaaattaaagaaattaaagagggttacctgtcgctggtaattcacgaaatctcgaaaatggtcatcaaatataatgcaattatcgctatggaggatctgtcctacgggttcaagaagggacgttttaaagtagagcgccaggtgtatcaaaaattcgaaaccatgttgatcaataagcttaactatttggtcttcaaagatatttcgattacggagaacggaggtttgttgaaaggatatcagctgacgtatatcccagacaagttgaaaaacgtggggcatcaatgtggatgtattttctatgtgcccgcggcctacacgagtaagatcgatcctaccactggtttcgtcaacattttcaaatttaaagatcttaccgtggatgcgaagcgcgaatttattaagaaatttgatagcattcgctatgattccgaaaagaacctgttctgttttacgttcgactataacaatttcattacccaaaacacggtgatgagcaaatcctcttggtcagtttatacatacggtgtacgtatcaaacgccgtttcgttaacggacgcttttccaatgagtctgatacaatcgatatcacgaaagatatggaaaaaacattagagatgactgatatcaactggcgtgacgggcacgacctgcgtcaagacattattgactacgagattgtgcagcatatcttcgaaatctttcgcttaactgtgcaaatgcgtaactcgttatccgagttagaagaccgtgactacgatcgcctgatttcacccgtcttgaacgaaaataacatcttctacgattccgcgaaggctggggacgcattgcccaaggacgcagacgcgaatggagcgtactgtattgcgcttaaaggattatatgaaatcaagcagatcaccgaaaattggaaggaggacgggaagttctcacgcgacaaactgaagatttcaaataaggactggttcgatttcattcagaataagcgttacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 91 - DNA, 3960 bp, Artificial Sequence
  Description of Artificial Sequence: Synthetic polynucleotide
ccagcggctaaaaaaaagaaactggatggcagcgtggatatgaataatggtacgaacaactttcagaacttcatcggcatctccagccttcaaaagactttacgcaacgcattgattcccacggagactacgcaacagtttatcgtaaaaaatggtattatcaaagaagatgaattacgcggggagaatcgccagattcttaaggacattatggacgattattaccgtggattcatcagtgagacactgagctccattgatgacatcgactggacgtcattgtttgaaaagatggaaatccagttgaaaaatggcgataacaaagatacattgattaaagagcagacagagtaccgcaaagcaattcacaagaaattcgccaatgatgatcgttttaagaacatgtttagtgccaagcttatttcggatatcttacccgaattcgtgattcacaacaacaattattcggcaagtgagaaagaggaaaagacccaggttatcaaattgttttcgcgcttcgccacttcgttcaaagattatttcaagaaccgtgcaaactgtttctccgctgacgacatcagttccagctcatgccaccgtattgtaaatgacaatgcggagatctttttcagtaatgccttagtatatcgtcgcattgtaaagagcttatctaatgatgacattaacaagatctcgggtgatatgaaggactcacttaaggagatgagtctggaagagatctactcctacgaaaaatacggggaattcatcacccaggagggaatttcattctacaacgatatctgcggcaaagttaactcctttatgaatctgtactgtcaaaagaacaaggagaataaaaacctgtataaattgcagaaacttcataaacaaattttgtgtatcgcagacacgagttatgaagtaccttataaattcgaatccgacgaagaggtatatcagtccgtaaatgggttcctggacaatatcagtagtaagcacattgtggaacgcttacgcaaaattggagacaattacaacgggtataacctggacaaaatctacatcgtatccaaattttatgaaagcgtgtctcaaaaaacttatcgtgattgggaaacaatcaacacggctcttgagatccattacaataacatcttgccgggtaacggcaaatcgaaggcagacaaagttaaaaaagcagttaagaacgacttacagaaaagcattacggagattaacgagttagtaagtaattacaaattatgctccgacgataatatcaaagctgaaacctacatccatgaaattagccacattttgaacaatttcgaagcgcaggagctgaaatataaccctgaaatccatctggtagagtctgagttgaaggcgtcagaactgaaaaacgttcttgacgtcatcatgaatgcctttcactggtgtagtgtttttatgactgaggagcttgtagataaggacaacaacttctatgctgaacttgaagagatctacgatgaaatctaccccgtaatcagtctgtataatttagttcgtaactacgtcacgcagaaaccctattcgactaagaaaattaagctgaactttgggatccctactttggcagacgggtggagcaagagtaaagaatacagtaataatgcaattatcttgatgcgcgataacttatattacttaggtattttcaatgctaagaacaaacctgataagaagattatcgaaggaaatacgagtgagaataagggagactacaaaaagatgatttacaacttgctgccagggcctaataagatgattccaaaagtttttctgtcgagcaagacaggggttgaaacttataagccatccgcttatatccttgaggggtacaagcagaataagcatatcaagtcctccaaagattttgatattacattttgccacgacttaattgattacttcaagaactgcatcgcaatccatcccgaatggaagaatttcggcttcgatttctcagatacgtccacgtatgaggatatctcaggcttttaccgcgaagttgagctgcaaggttataaaattgattggacatacatctccgaaaaagacattgatcttttacaggaaaagggccaattatacttatttcaaatctataacaaagattttagcaagaagtccacaggtaatgataacctgcatacgatgtatttgaaaaatcttttcagtgaagagaatttgaaggatatcgtcctgaagctgaacggtgaggctgagatcttcttccgcaaatcgtctatcaaaaaccccatcattcacaaaaagggaagtatcttagtaaaccgcacttatgaagcggaggaaaaggatcagttcgggaacatccagatcgtgcgcaagaacattccagaaaacatctatcaggaactttacaaatatttcaatgacaagtctgataaagaattatcagacgaggcggcgaaacttaaaaatgttgttggacaccacgaagcagcgacgaatattgtaaaggattatcgctacacatacgataaatactttttgcacatgccaatcaccattaactttaaggcgaacaagacaggtttcattaacgaccgtattctgcaatatatcgcaaaggaaaaagacctgcacgttattgggatcgatcgtggcgaacgcaatttgatctacgtaagcgttatcgacacttgcggaaatatcgttgaacaaaaaagctttaatatcgtcaatggatacgattaccaaatcaagctgaaacaacaagaaggggcacgtcagatcgctcgtaaagaatggaaagagattggtaagatcaaagagattaaagaagggtatctttctttagtaattcacgagatttcgaaaatggttattaaatacaatgcgattattgctatggaagacttaagctacggctttaagaaaggtcgcttcaaagtggagcgccaagtgtatcagaagtttgaaacgatgttgattaacaaattaaattacctggtctttaaggacatcagtatcacagaaaatggggggttgcttaaagggtaccagcttacatacatccctgataaactgaaaaatgtcggtcatcagtgcggatgtatcttctatgtaccagcagcctataccagtaagattgaccctactactggctttgtgaatatttttaaattcaaggatttaaccgtggacgccaagcgtgaatttattaaaaaatttgattcgattcgctacgacagtgagaaaaaccttttctgctttacctttgactacaacaattttattacccagaacaccgtaatgtcaaagagttcgtggtctgtatatacctacggtgttcgcatcaagcgccgcttcgtaaacgggcgtttcagtaacgaatctgacaccatcgacatcactaaagatatggagaagacattggaaatgacggacattaattggcgtgatggccatgacttacgtcaggacattattgattacgaaattgtgcagcatatcttcgagattttccgtttgacagttcagatgcgcaactcactgagtgagttagaagatcgcgattacgaccgtctgatctcaccggtccttaatgaaaacaacattttctacgactcagcaaaggcgggtgatgccctgccaaaggatgcggacgctaatggcgcctactgcatcgccctgaaaggattgtatgaaattaagcagattacagaaaattggaaggaagatggtaaatttagccgtgataaattaaaaatctcgaacaaggattggttcgattttattcagaacaaacgttatttgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 92 - DNA, 3960 bp, Artificial Sequence
  Description of Artificial Sequence: Synthetic polynucleotide
ccagcggctaaaaaaaagaaactggatggcagcgtggatatgaacaatggaacaaataattttcaaaattttatcggcatctcaagtcttcaaaaaacccttcgcaatgccctgattccaactgaaacaacccagcaatttatcgtcaagaacggcatcattaaggaagacgagttacgcggggagaaccgtcaaatcctgaaagatatcatggatgactactatcgtgggttcatttcggaaaccttgtcttcaatcgacgacattgactggacgagtcttttcgagaaaatggaaattcagcttaaaaatggagacaacaaggatactctgattaaggaacagacagaatatcgcaaagctatccacaaaaagttcgctaatgatgatcgtttcaaaaatatgttttctgctaaattgatttccgatatcttgcctgaatttgtaatccacaacaacaattattctgcttccgagaaggaagagaagacccaggtcattaaattattcagccgctttgcaaccagctttaaagactactttaagaatcgcgctaactgcttttcggcggatgacatctcatcatcatcatgccaccgcattgtgaacgacaatgcggagatcttcttttcgaatgcgttagtttatcgtcgcattgtcaaaagtcttagcaatgatgacatcaacaagatctcaggagacatgaaagattccttaaaggagatgtctcttgaggaaatctattcgtatgagaaatacggcgagttcattacccaggaaggtattagtttctacaatgatatctgcggcaaagtaaattcttttatgaatctgtattgccaaaaaaacaaagaaaacaagaatctttataagttacaaaagttacataagcaaattctgtgcatcgctgatacatcttatgaggtaccctacaaatttgaaagtgatgaggaggtctatcagagtgtcaacggcttcttagacaacatctcttccaaacatatcgtggaacgcctgcgtaaaatcggagataactacaacggatataacttagataaaatctacatcgtgtccaagttttatgaaagtgtgagccaaaaaacatatcgtgactgggaaaccattaacaccgcattggaaattcactataacaacattttgccaggcaacgggaaaagtaaggcggacaaagttaagaaagcagttaaaaatgacctgcaaaaaagcatcactgaaattaacgaattggtatcgaattacaaattatgtagcgacgataatatcaaagcagaaacttacattcacgagattagtcacattttaaataacttcgaggcccaggaattgaaatacaatcccgaaattcatttggttgaatcagaactgaaagcatcagagttgaaaaatgtgttagatgtcattatgaatgcgtttcattggtgctctgtgttcatgaccgaggaactggttgataaagataacaacttttacgctgaattggaggagatttacgatgagatttacccggtcatttcgctttataacttagtgcgcaattatgtgacgcagaaaccatattccacgaagaaaatcaaacttaattttggcatccctactctggctgatggttggtcgaaatcgaaagagtacagcaacaacgcgatcattcttatgcgtgacaatctttactatttgggcatttttaatgccaagaataagccagataagaaaatcattgaggggaatacttccgagaataagggggattacaaaaagatgatctataacttgctgcccggccccaacaaaatgattcctaaggttttcttgtcaagcaagacgggcgtcgaaacatataagccgtcagcttatattctggaaggctataaacagaataagcacatcaagtcttccaaggactttgacatcactttttgccacgatttgatcgactactttaagaactgtattgcgattcatccggaatggaagaacttcggtttcgacttttccgatacctcaacatacgaggatatcagcggcttctaccgtgaagtcgagcttcaaggctacaagatcgattggacatatatttcagagaaggacattgatttgttacaagagaaaggtcaactttacttatttcagatctataacaaagacttttcgaagaaatcgacaggaaacgataacttacacactatgtatttaaaaaatctgttttcggaggaaaacctgaaagatattgtgctgaaacttaacggcgaggcagagatctttttccgtaaaagctcaatcaagaatcctatcatccataaaaaaggtagtattcttgtcaaccgcacatatgaagcggaggagaaggaccaattcggaaacatccaaattgtccgtaagaatattccggagaacatttaccaagagttgtataaatactttaacgataagtcagataaggaacttagcgatgaggcggcgaagcttaaaaacgtagttgggcatcatgaagctgctaccaacattgtaaaagattaccgttacacctatgacaagtatttcttgcacatgcccattacgatcaatttcaaagcaaataagacaggctttatcaatgatcgcatcctgcagtacattgctaaagagaaggatttgcatgttatcggtattgatcgcggagagcgcaatttgatctacgtctccgtaatcgacacttgcggtaacattgttgagcagaagtcgttcaacatcgttaatggttatgattaccaaatcaagctgaagcagcaagagggtgcccgccagatcgcgcgtaaggaatggaaagaaatcgggaaaattaaagagatcaaagaaggctatttgtctctggtaattcacgaaatcagcaagatggtgatcaagtataacgcgatcattgcgatggaggatctttcttatggcttcaagaaagggcgctttaaagtcgaacgccaggtctaccagaaatttgagacaatgcttatcaacaagcttaactatcttgtatttaaggatatttccatcactgagaacggaggacttttaaaggggtaccaactgacgtacattcctgataagctgaagaacgttggtcatcaatgcggatgcatcttctatgtgccagcggcttacacctccaaaatcgatcccactacaggctttgtcaatatcttcaaattcaaggatttgaccgttgacgcgaagcgcgagtttatcaagaagtttgatagcattcgctacgacagcgaaaaaaatttattttgttttactttcgactacaataactttattactcagaacactgtcatgtcaaagagttcgtggagtgtctacacgtacggagtacgtattaagcgccgtttcgtcaacggacgcttctcaaacgaaagcgacacgatcgacatcaccaaagacatggaaaaaactcttgagatgacggatatcaattggcgcgacggccatgacctgcgtcaggatatcattgattacgagatcgttcagcacatcttcgaaatcttccgccttaccgtccagatgcgcaacagtttaagcgagcttgaagaccgcgactacgatcgtttgattagccccgttctgaacgagaataatattttctacgacagcgcaaaggccggtgatgctttgccaaaggacgcagacgcgaatggagcctactgcatcgccctgaagggcttatatgagattaagcaaattaccgaaaattggaaggaagatggtaagttctcccgtgataagcttaaaattagcaataaggattggttcgacttcatccagaacaaacgttacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 93 - DNA, 3960 bp, Artificial Sequence
  Description of Artificial Sequence: Synthetic polynucleotide
ccagcggctaaaaaaaagaaactggatggcagcgtggatatgaacaacggaacaaacaatttccaaaacttcatcggtatctcttcgttgcagaagactctgcgtaatgctttgatcccgacggagacaacccaacaatttatcgtcaaaaacggtattattaaggaggacgagttacgtggagaaaatcgtcaaatccttaaggacatcatggacgattattatcgcgggtttatttctgaaaccctgagcagtatcgatgatatcgactggacctcactttttgagaaaatggagatccagttgaagaacggtgataacaaagacactctgatcaaagagcaaactgaataccgcaaggcaattcacaaaaagttcgccaacgacgaccgtttcaagaatatgttctcagctaagttaatcagcgacattttgccagagttcgttatccacaacaataattatagtgcttcagagaaggaggaaaaaacccaagtgattaaacttttttcgcgctttgcaacctcattcaaggactacttcaagaatcgcgcgaattgcttcagtgcggacgacatttcttcttcaagttgccatcgtatcgttaacgataacgcggaaattttcttctctaatgctttggtgtatcgccgcattgtaaaatcgcttagtaacgatgacattaataagatctcaggtgatatgaaagattcattgaaggaaatgagcttggaagagatttacagttacgaaaaatatggagaatttattactcaggaaggcatctcattctataacgatatctgcgggaaggtaaattcgtttatgaacttatattgccagaaaaataaagagaataaaaatttgtataagcttcagaagttgcacaaacagatcctgtgcattgcagacacctcgtatgaggttccgtataaatttgagtccgatgaagaagtgtatcagtctgtgaatggtttcttagataatatctcttccaagcatattgtcgaacgcctgcgcaaaattggtgataactataacggatacaatctggataaaatttacatcgtttctaaattttacgagtcagtctcgcagaagacctaccgcgactgggaaacaattaacacggcattggagattcactacaataatatcttgcctggtaacggtaagtctaaggcagataaggtaaaaaaagctgtgaaaaacgaccttcagaaaagcatcacggagattaatgagctggtgagtaattacaaattatgttcagacgataatattaaagctgaaacgtatatccatgaaatctcgcatatcttgaacaacttcgaggcccaagaacttaaatataaccccgaaatccatttagtcgagtctgaattgaaagcgtcggaattaaaaaacgtcttagacgtcattatgaacgcgtttcactggtgttcagttttcatgaccgaagagctggtcgacaaagacaacaacttctatgcggaattggaggaaatctatgatgaaatctaccctgttatttcactgtataaccttgtgcgcaactatgtcactcagaagccgtattcgaccaaaaaaattaaattgaatttcggtatccctactcttgcagacggatggagtaaaagcaaggaatacagtaataacgccattattcttatgcgcgacaatttatactacctgggcatctttaacgcaaagaataagccggataagaagattattgagggtaacaccagtgagaacaagggcgactataagaagatgatctataacttattgccaggtccaaataaaatgatcccaaaagtattcttatcatcaaagacgggagttgaaacctataagcctagtgcctatattcttgagggatataaacagaacaagcacattaagtcgtctaaggattttgacattacgttctgccatgacttaatcgactattttaaaaactgtattgcgattcaccccgaatggaagaattttggattcgatttttcggatacctcgacctatgaagatatttcgggattttatcgtgaagtggagttgcaaggctataaaatcgattggacctatatctcagaaaaagacattgatttattacaggaaaagggacaactgtaccttttccaaatttataacaaggacttttctaaaaagtccacaggaaatgataaccttcacaccatgtacctgaagaaccttttctcagaggaaaacctgaaggacattgtccttaagttaaatggagaagcggagatctttttccgtaaatctagtatcaagaatccgattatccataaaaaaggttcgattttggtaaatcgcacctatgaagcggaagagaaagatcaatttggtaacatccagatcgtgcgcaagaatatcccggagaacatttaccaagagctgtataagtacttcaatgataagtctgataaggaactgtcagatgaagctgcgaaattgaagaacgtggttgggcatcatgaagccgctaccaatatcgtcaaggattaccgttatacctatgacaaatatttcttacacatgccgattacgatcaattttaaggcaaacaagacaggattcatcaacgaccgtatcttgcagtatattgccaaagagaaggatctgcatgtgatcggtattgaccgcggggagcgcaatttaatctatgtatcggtgatcgatacttgtggtaacatcgtagaacaaaagagctttaacatcgtgaatggttacgactatcagatcaagctgaaacaacaggaaggagcccgccagatcgctcgcaaggaatggaaagaaatcgggaaaattaaggaaatcaaggaaggctacctttcattggtcattcacgaaatttcgaaaatggtaattaagtacaacgcgatcatcgccatggaggacctttcgtacggatttaagaagggtcgtttcaaagttgagcgccaggtataccaaaaattcgagactatgcttatcaacaaacttaactacttggtctttaaggacatttctattaccgaaaacggcggcttacttaaaggctatcaattgacatatattcccgacaaactgaagaatgttggacatcaatgcgggtgtattttctatgtgccggcagcttacactagtaagatcgaccctacaaccgggttcgtaaacatttttaaattcaaagacttaacagtcgatgcgaagcgtgaatttattaagaagtttgatagtatccgctatgacagtgaaaagaacttgttttgctttacgttcgactacaataactttattacacagaacacggtcatgtctaaatcatcatggtcggtttacacatatggggtgcgcatcaagcgtcgctttgtaaatggccgttttagtaatgagagcgacacaatcgacatcacaaaggatatggagaaaactcttgagatgacagacatcaattggcgtgacggtcatgacttacgccaagatatcatcgactacgaaatcgtacagcatatttttgagatttttcgtcttactgtgcaaatgcgtaattctttatccgaactggaagatcgtgattacgaccgcttgattagtcccgtcttaaatgagaacaatattttctatgattctgcgaaagccggagatgcactgcccaaagacgctgatgccaatggcgcgtattgcattgcattaaaaggattatatgagattaaacagattaccgaaaattggaaagaggacggtaaattctcacgcgataaattgaagatttctaacaaggactggttcgactttatccaaaataaacgttatcttaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 94 - DNA, 3960 bp, Artificial Sequence
  Description of Artificial Sequence: Synthetic polynucleotide
ccagcggctaaaaaaaagaaactggatggcagcgtggatatgaataacggtaccaacaactttcagaatttcattggcattagctcgcttcaaaaaactttacgcaatgctcttattccgactgagacgacacaacagtttatcgttaagaatggcatcatcaaagaagatgaattacgcggagaaaaccgccagatcctgaaagacattatggacgattattaccgtgggttcatctccgagacgttgtcatcgatcgatgacatcgactggacgtcactttttgaaaaaatggagatccagttaaagaacggtgacaataaggatacattgatcaaagaacagaccgagtaccgtaaagcgattcataaaaagtttgcgaacgatgatcgcttcaagaatatgttttctgcgaaattaatttccgacattttacctgaatttgttattcataataacaactactcggcgtctgagaaagaggagaaaacccaagtgattaaacttttttcacgtttcgcaacgtcgttcaaagactattttaaaaatcgtgctaattgctttagcgcggatgacatcagctctagttcatgtcatcgcattgtcaacgataatgctgagatctttttcagtaatgcgttagtgtaccgtcgtattgtgaagtccttatctaatgatgatatcaataagatcagcggggatatgaaggactcacttaaggagatgagcttggaggaaatctattcctatgagaagtatggtgagtttattacgcaagaaggaattagcttttacaacgatatctgtggaaaggtgaattcgtttatgaatttgtattgccagaaaaataaggagaacaagaacctttataaattgcaaaagttacacaagcaaatcctgtgcattgcagatacttcctacgaggtgccttacaagtttgaatccgacgaagaggtctaccaatctgtaaacggtttcttagataatattagttccaagcatattgtggagcgccttcgtaaaattggcgataattacaacggttacaatttagacaaaatttacattgtcagtaaattctacgagtccgtatctcaaaagacgtatcgtgattgggagactatcaatacggccctggagatccactacaacaatatcttgcccggtaatggtaagtcgaaggccgataaagttaagaaagcggtgaaaaatgacttacagaagtcaatcaccgaaattaacgaattggtgtccaattataaattgtgttcagatgataatatcaaagccgagacctacattcatgagatttcccatatcttaaataatttcgaggcgcaagagcttaagtataacccagaaatccacctggtagaatctgagttgaaggcgtcagagttaaaaaatgttttagatgtcattatgaacgcgtttcactggtgctccgtatttatgacggaggaattagtagataaagacaacaatttctatgccgaacttgaggaaatctatgatgagatctatcccgtcattagcctgtataacttggtccgcaactatgttacccaaaaaccgtacagtaccaagaagattaagctgaatttcggcattcctacactggctgatggttggagtaaatcgaaggaatattcgaataacgcgattatcttgatgcgcgacaacttatactatttggggatctttaacgccaaaaacaaaccggataagaagattattgagggaaacacatcagagaacaaaggcgactacaaaaaaatgatttacaacttgttaccggggcctaacaaaatgatcccgaaggtgttcttatccagtaaaacaggcgttgagacctacaaaccttccgcatacatcctggaagggtataagcagaacaagcacattaagtccagcaaggatttcgatattaccttctgtcatgatttaattgactatttcaagaactgtattgcaatccaccccgagtggaagaacttcggattcgacttctcagatacgagcacatatgaggacatctcggggttctatcgtgaagtagaactgcagggatataaaattgattggacatatatttccgaaaaagacatcgaccttttacaagagaagggtcaactttacttgttccaaatttacaataaagacttctcaaaaaaaagcacgggtaacgataatttacacactatgtatttaaagaaccttttctcggaagagaatttaaaggatatcgtattgaagttgaatggagaagcggagatcttcttccgtaagtccagtattaaaaaccctattattcacaagaagggatcgattttagttaaccgcacatacgaggccgaagagaaggaccaatttgggaacattcaaattgtccgcaaaaacatccctgagaacatttatcaagagctttataagtactttaacgataagtccgataaggaattgtcagatgaggcggcaaagttgaagaatgtcgtggggcatcatgaagctgccaccaacattgtgaaggactaccgctacacttacgacaaatacttcctgcacatgcccattacgatcaattttaaggccaataagacaggctttattaacgaccgtattcttcaatatatcgctaaggagaaggaccttcatgtgattgggatcgaccgcggagaacgtaatttaatttatgtgtccgtcatcgatacgtgtggaaatatcgtggaacagaaatcattcaatatcgtgaatggctatgattaccagatcaaattaaaacagcaggagggcgctcgccaaattgcgcgtaaggaatggaaagagatcggaaaaatcaaagaaatcaaagaaggatatttgtcattggtgatccatgagatttcaaaaatggtaattaaatataatgcaattatcgcaatggaagacctgtcctatggttttaagaagggtcgtttcaaggtagaacgccaagtgtatcaaaagttcgagacgatgctgatcaataagctgaattatcttgtgtttaaggacattagcatcacggaaaatggagggctgttgaaaggctatcaactgacgtatatccctgacaagctgaaaaatgttggccatcagtgcgggtgcattttctacgtccccgcggcgtatacaagcaagatcgatcctactacgggattcgtaaatatttttaaattcaaagacttaaccgtggacgccaagcgcgaattcattaagaagtttgatagcattcgctacgattcagaaaaaaatcttttctgttttacgttcgattacaacaattttatcacccagaacacagtgatgagcaagtcatcctggtctgtctatacctacggtgtccgtatcaaacgccgcttcgtcaacggacgcttctctaatgaatctgataccattgacatcaccaaggacatggaaaagacacttgagatgacagatattaactggcgtgacggacatgacctgcgtcaggacatcatcgattatgagattgttcagcatatcttcgagatcttccgcctgacagtacaaatgcgcaattcactgtcagaacttgaagaccgcgactatgaccgcctgatctctccagtattaaatgagaacaatatcttttatgacagtgctaaggccggcgatgcccttccgaaagatgctgatgctaacggagcttattgtattgcattaaagggtctttatgagatcaagcaaattaccgagaattggaaggaggatggcaaattctcgcgcgacaaactgaaaatcagtaacaaggactggttcgattttattcagaataaacgttacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 95 - DNA, 3960 bp, Artificial Sequence
  Description of Artificial Sequence: Synthetic polynucleotide
ccagcggctaaaaaaaagaaactggatggcagcgtggatatgaataacggaacgaacaacttccagaacttcatcggcatcagttctttacaaaaaaccctgcgtaacgcccttattccgactgagacaacacaacagttcatcgttaaaaacggaattatcaaagaggacgagttgcgcggcgagaatcgccaaattttgaaagatattatggacgactattatcgtggttttatttcagaaacactgagttcgattgacgatatcgattggacgagcctgtttgagaaaatggaaatccagttgaaaaatggcgataataaagacactttaatcaaagaacaaaccgagtatcgtaaagcgatccataaaaagttcgctaatgacgatcgttttaagaatatgttcagtgcgaaactgatttcagacattttgcccgagttcgtgatccataataacaactattccgcctcggaaaaggaagaaaaaacccaggtgattaagctgttcagtcgcttcgcaacatctttcaaggattatttcaagaatcgcgcgaattgcttcagtgcggacgatatttctagttcaagctgccatcgtatcgttaatgataacgcggagattttttttagcaatgctctggtgtaccgccgcattgttaagtcactgtccaacgatgatattaacaagatctcaggagacatgaaagactcgcttaaagagatgagtctggaagagatctattcttatgagaagtatggcgagtttattacccaagaaggaatctcattctacaatgatatttgtggaaaggtgaacagctttatgaatctttactgccaaaaaaacaaggagaataagaatctttacaaacttcagaagttacataaacagattttgtgtattgcggatacgtcttatgaagtcccctacaaatttgaatcggatgaagaggtataccaaagtgtgaacggattcttggacaatatttcttctaaacatattgttgaacgcttacgtaagatcggggataactacaatggctacaatcttgacaaaatctacattgttagcaaattctacgagagtgtcagccaaaagacgtaccgcgattgggaaacaattaatactgcgcttgagattcactataataacattttaccaggcaacggcaagtccaaggcggataaagttaaaaaagctgttaaaaacgatttgcaaaaatctatcacagaaattaacgagttagttagtaactacaaactgtgctccgatgacaacattaaggctgagacgtatatccatgagatctctcacatcttaaacaattttgaagctcaagaacttaagtacaatccggaaatccacctggtggaatccgagctgaaggctagcgaactgaagaacgtattggacgtgatcatgaacgcgttccactggtgttctgtctttatgacggaagagcttgtcgacaaagataataacttttacgcggaacttgaggaaatttacgatgagatttacccagttatttcattgtataaccttgtccgtaattacgtgacccaaaagccttatagtacgaaaaaaatcaaattaaattttggaatcccaacactggctgacggttggagcaaatctaaggagtattctaataacgcaatcatcttaatgcgtgacaacctgtattatttgggtatcttcaatgccaaaaataagcctgacaaaaagattatcgaaggaaatacttcggagaataagggggattacaaaaaaatgatttacaatttgctgcccgggccgaacaagatgatccccaaagtgttcttatcctcgaagactggtgtagaaacatacaagccaagcgcatacattctggagggttacaagcaaaacaaacacatcaaatcttcaaaagactttgacattacattttgccatgatcttattgactacttcaaaaactgcattgctattcaccccgagtggaagaactttgggtttgacttcagcgacacgtctacgtatgaggacatctccgggttctaccgtgaagttgagttacaagggtataagattgactggacgtatatttcagagaaagatatcgatcttttgcaggaaaagggccagttatatttattccagatttacaacaaggactttagtaagaagtcaacaggaaatgacaacttgcatacgatgtatttgaaaaatcttttttctgaggaaaatcttaaggacatcgtactgaaattgaatggcgaggctgaaatcttcttccgtaaatcctccattaagaatcccattatccacaaaaaggggtctatcctggtgaatcgtacctacgaggcagaggagaaggatcaattcggaaatattcagattgttcgtaagaacatccccgagaacatttatcaagaattgtataagtactttaatgacaaatctgacaaagagttatccgacgaagctgcgaaactgaaaaacgttgttggtcaccacgaggccgccactaatatcgtaaaagactaccgttatacctatgacaagtactttttgcacatgccgatcactatcaacttcaaggcgaataagacgggcttcattaacgatcgtatcctgcaatacatcgccaaggagaaggaccttcacgtcattgggattgaccgtggtgagcgtaacctgatttatgtaagcgtcattgatacctgcggtaatatcgtcgaacagaaaagtttcaacattgtaaatggatatgactatcagatcaaacttaagcagcaggagggtgcacgccagattgcccgcaaggaatggaaggagattgggaagattaaggaaattaaagaaggttacttatcactggttattcacgagatcagtaaaatggtaatcaaatataacgcgatcattgccatggaggatctgagctatggctttaaaaagggccgtttcaaagtcgagcgccaggtatatcaaaagtttgaaacaatgctgattaacaaattaaactatctggttttcaaagatatttcgatcactgaaaatggcgggctgttgaagggataccaacttacatacatccctgacaaactgaaaaatgtcggtcaccaatgtggatgtatcttttatgtaccagcagcgtatacgagcaaaatcgatccaactacgggttttgtgaacatctttaagttcaaggatttgacagtagatgccaaacgcgagttcattaaaaaatttgattcaattcgctacgattcagagaaaaatcttttttgtttcacgttcgattacaataatttcattacgcagaacacagtaatgtcaaagtcaagctggtcggtctacacgtatggagtccgtattaaacgtcgttttgtaaacggccgtttctcaaatgaatcagatacaattgatattacgaaggatatggagaagacattagagatgactgacattaactggcgcgacggacatgatcttcgtcaggacattattgattatgagattgtacagcatatctttgagatcttccgcctgaccgttcagatgcgcaattcgttgtccgagttagaagaccgcgattacgaccgtttaatcagtcccgtcttaaacgaaaataacatcttctacgattcagccaaggcaggcgatgccttgccaaaggatgctgacgcaaatggcgcatactgtattgcgttgaaaggcctttatgaaatcaagcaaattaccgaaaactggaaagaagacggaaaattctcccgtgataagttgaaaatctctaataaggattggttcgatttcatccaaaataaacgctatttgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 96 - DNA, 3959 bp, Artificial Sequence
  Description of Artificial Sequence: Synthetic polynucleotide
ccagcggctaaaaaaaagaaactggatggcagcgtggatatgaacaacggaactaataatttccaaaattttataggcatctcttctttacagaagactcttcgtaacgccctaatcccgactgagaccacacaacaattcatagtgaaaaatgggatcattaaagaagacgagctgcgtggggagaacaggcagatcctaaaagacataatggacgattattatagagggttcatctcagagacattatctagcatcgacgacattgactggacctccctgtttgaaaaaatggaaatccagctgaagaatggtgacaataaagacacattaataaaagaacaaacagagtacaggaaagccatccacaagaagttcgcaaacgatgacagattcaaaaatatgttcagtgcgaagctaatatccgacatcttaccagagtttgtaatacacaataacaattacagcgcgagcgaaaaggaagagaaaacgcaagtaattaagctttttagtaggttcgctacctctttcaaagattacttcaaaaatcgtgctaactgcttctcagccgacgacatatcttcaagttcctgtcaccgtatcgtgaatgataacgctgagatattcttctcaaacgcccttgtataccgtaggatcgtaaagtccttatctaacgatgatataaacaagatcagtggagacatgaaagacagccttaaagagatgtctctagaagaaatttactcctatgaaaagtatggggagtttataacacaggaggggatcagcttctacaacgacatctgcggaaaggtgaacagtttcatgaatctttactgccagaagaataaagagaacaaaaatctttataagcttcaaaagttgcacaaacaaatactgtgcattgccgatacatcatatgaggtcccctataagttcgaatctgatgaggaagtttatcaatctgttaacggctttctagacaatatcagctcaaaacacatcgtagaaagactgaggaaaataggtgataattataatggatacaacttggataaaatatatatagtctctaaattttacgagtcagtatcccagaaaacgtatagggattgggagaccatcaacacggcgttagagattcattacaataacatcttaccgggaaacggaaaaagtaaggcggacaaagtaaagaaagccgttaaaaatgacttacaaaagagtataacagaaataaacgaactagtaagcaactacaagctttgttccgatgataatatcaaggccgagacatatatccatgagatctcccacattctaaacaatttcgaagcgcaagaacttaaatataatcccgaaatccacctggtggaaagtgaactaaaggctagtgagttaaagaacgttcttgatgttatcatgaacgccttccattggtgctctgtttttatgaccgaggagttggttgataaagataataatttctacgctgaattagaggagatatacgacgaaatctacccagtgatttcactatacaacttggtcaggaactatgttacacaaaagccgtacagcactaagaaaattaagctaaatttcggtatccccacgttagccgacgggtggagcaagtccaaagaatattccaacaatgcgattattttaatgcgtgacaatctttattaccttggcatcttcaatgccaaaaacaaacctgacaaaaagattatagaaggtaatacgtccgagaacaaaggcgattacaagaagatgatttataacctactgcccggaccaaacaaaatgatccccaaagtttttcttagttctaaaaccggcgtagagacgtataaaccttctgcctatatcttagagggatataagcagaacaaacatatcaaatcttccaaggactttgatattacattctgccacgatttaattgactacttcaaaaattgcatagcgatacatccggagtggaagaactttggcttcgacttcagtgatacatccacctatgaggatatatcaggcttctatcgtgaggtcgaattgcaagggtacaaaatcgattggacgtatatatccgagaaagacatagaccttcttcaagaaaaggggcagttatatttattccaaatatacaacaaggacttcagtaagaagtcaacaggtaatgacaacttacacaccatgtacttgaaaaatttattttctgaagaaaacctaaaggacattgtactaaaactgaacggggaggcagaaattttttttagaaagagcagcataaaaaacccaataattcataagaaaggaagcattttagttaataggacgtacgaggcagaggaaaaggaccagtttggcaatatccagatcgtaaggaaaaatattcctgaaaacatatatcaggaactatataaatactttaacgacaaatccgacaaagaattatccgacgaggctgcaaagctgaagaacgtcgtagggcaccatgaggcagcgactaatattgtgaaagactataggtatacatacgacaaatactttctgcacatgcccatcacgattaacttcaaggcgaacaagacgggattcattaacgaccgtatattacaatatattgctaaggagaaagatctgcatgtaataggtatcgacagaggcgaacgtaatttaatctacgtgtccgtcatcgacacgtgcgggaacatcgtagagcaaaagagttttaatatagtaaatggctatgattaccaaattaagctaaagcagcaagaaggagcaagacagatagctaggaaagaatggaaggagataggaaaaataaaggagatcaaggaggggtatcttagcctagtaattcatgaaatatctaagatggttatcaaatacaacgctatcatagcgatggaagacttatcttatggtttcaagaaaggaaggttcaaagtagagcgtcaagtttatcaaaagttcgaaacgatgttgattaataaactaaactatttggtatttaaagatatatctatcaccgagaatggtggtctactaaagggttaccagcttacatacataccggacaaacttaaaaacgtcggacatcagtgtggatgcattttctacgttccagctgcatataccagcaagatcgacccaacgactgggttcgtaaatatttttaaattcaaggatttgactgtcgacgccaaaagagagttcataaaaaagttcgattcaattaggtacgacagcgaaaagaatttgttctgctttacttttgactataacaatttcattactcagaacactgtaatgtctaagtcctcttggtcagtctatacttatggcgttcgtatcaaacgtagatttgttaacggtagattctcaaatgaaagtgatacaatagatatcacgaaagatatggagaaaacattagaaatgacagacataaactggagagacggacatgacttgagacaggacattattgactacgagatcgtgcagcacatctttgagatctttcgtttgaccgtacaaatgcgtaacagtttatctgagcttgaggacagggactacgatagattgatatcacctgtattaaatgagaataacatcttctatgattccgcaaaagcaggcgacgctctacccaaagacgctgatgcgaacggtgcttattgcatagctttaaagggtttgtatgagatcaaacagataacagaaaattggaaggaagatggtaagttctcccgtgacaagcttaaaatatcaaataaggactggttcgattttatacagaataagcgttattaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 97 - DNA, 3960 bp, Artificial Sequence
  Description of Artificial Sequence: Synthetic polynucleotide
ccagcggctaaaaaaaagaaactggatggcagcgtggatatgaacaatggaactaataacttccagaatttcattggtatctcctctttacaaaaaactctaagaaacgccctaattccgactgaaactacacagcaattcatcgtcaaaaacgggatcattaaggaggatgagttgaggggtgaaaatcgtcaaattcttaaagacatcatggacgactactacagggggttcatcagcgagacgttatctagtatagacgatatagactggacttcactgttcgagaagatggaaatccaattaaaaaatggggacaataaagatacacttataaaggaacagacagagtatagaaaggcaatacacaaaaagtttgccaacgacgatcgtttcaagaacatgtttagtgctaaattgatttcagatattctgccggaatttgttattcacaacaataattatagcgccagtgagaaagaagaaaaaacgcaggttatcaaactgttcagtcgtttcgctacatcttttaaggattactttaaaaaccgtgcaaattgtttttcagccgacgatattagtagcagctcttgtcaccgtattgttaatgataatgcggagattttcttttcaaacgcattggtctacaggaggatagtcaagtccctttcaaatgacgacattaataagatctcaggtgacatgaaagattccttaaaggaaatgtccctggaagagatctattcctatgaaaagtacggtgagttcattactcaagagggtataagcttttacaatgacatatgtggtaaggttaatagctttatgaacctgtattgccagaagaacaaagaaaataagaatctgtataagttgcaaaagctacacaaacaaattttgtgcattgccgatacatcatacgaggtgccatacaaattcgagagcgatgaggaggtttatcagagcgtgaatggattcctggacaatattagtagtaagcatatcgtggaaaggcttagaaagataggtgacaattacaatggctacaatctggataaaatctacatcgtctcaaaattctatgaaagtgtatcccagaagacgtaccgtgattgggaaactatcaacaccgctctggagatacattacaacaatatacttcccggaaacggcaagtcaaaagccgacaaagtcaaaaaagcggtcaagaacgatttacaaaagtctatcactgaaattaatgaattagttagtaattacaaactgtgtagtgatgataatattaaggcagagacttacatacacgaaatttcacacattttaaacaacttcgaggcacaggaacttaaatataatcctgaaattcacctggttgaaagtgaattgaaagccagcgagctaaagaacgttttggacgtaatcatgaacgcattccactggtgctctgtctttatgacagaggaactagtggataaggacaataatttttatgcggagctggaggaaatatacgatgagatatatcccgtaatatcattatataatctggtaagaaactatgtgactcaaaagccgtatagcaccaagaaaattaaacttaatttcggcatacccactttagcggacggctggtcaaaatccaaagagtatagtaataatgccatcatcctgatgcgtgacaacctgtactatttaggtatatttaacgccaaaaataaacccgacaaaaagattatagagggcaacacctcagagaacaaaggtgattataagaagatgatttacaaccttttacccggtcctaataagatgattcccaaagtctttctatctagcaaaactggtgttgaaacatacaaaccctcagcttatattttagaagggtataagcagaataagcatattaaaagctccaaagatttcgatattaccttttgccatgacttgatagactatttcaaaaattgtattgccattcaccctgaatggaaaaacttcggatttgacttctctgacacatccacctacgaagacatttcaggtttttacagggaagtcgagctacagggttataaaattgattggacatacatcagcgagaaagatattgacctacttcaagaaaaagggcagctatacctgttccagatatacaataaagacttcagtaaaaaaagcaccgggaacgataatcttcacacaatgtacttaaaaaatttatttagtgaagagaatctgaaggatatagtgctgaagttaaacggggaggcagagatattttttagaaaatctagtattaagaatccgatcatccacaagaagggttctatccttgttaataggacttatgaggcagaagaaaaagaccaattcggcaacatacaaattgtccgtaaaaatatccctgagaacatttatcaggaactatacaagtacttcaatgataaaagcgacaaggagctgagcgacgaggctgctaagttaaagaatgtggtgggccaccatgaggcagcaacgaatattgtgaaggactatcgttatacctacgataaatactttcttcatatgccgatcaccattaatttcaaggcaaacaaaactggcttcattaacgatcgtatcttacaatatatcgcaaaagagaaagaccttcacgttatcgggatcgatagaggcgagcgtaacctaatttatgtttctgtgatagacacctgtgggaacatagtcgaacagaaatcatttaatattgttaacggctacgattatcagataaagttgaagcaacaagagggtgcacgtcaaatagcaaggaaagaatggaaagaaataggcaagattaaagaaataaaagaaggttatttatcccttgtaatacacgaaattagcaaaatggtgattaaatataatgcgatcattgccatggaggatctttcttacggcttcaaaaaggggagattcaaagtcgagaggcaggtgtatcagaagtttgagaccatgctaatcaataaactaaattatctagtattcaaagacataagcatcaccgaaaatggcggcttgttgaagggttatcaattgacctacatcccagataaactaaaaaacgtagggcatcaatgcggatgtatattttacgttccagccgcatacacttccaaaatcgatccaactacgggttttgtgaacatcttcaaattcaaagacttgactgtcgatgctaagagggagtttatcaagaaatttgactccattagatacgacagtgagaagaatctgttctgttttacctttgattataacaactttataactcaaaacacagtcatgagtaagtcatcttggtcagtgtatacgtatggtgtgaggattaaaaggaggtttgttaacgggagattttccaatgaaagtgatacaatagatataaccaaggacatggaaaagactcttgaaatgaccgacattaactggagagatggccacgacttacgtcaagatataatcgattacgagatagtgcaacatatctttgagatatttaggcttactgtccaaatgcgtaactcattaagtgagttggaggacagggattacgataggctaataagtcctgttcttaacgaaaacaatatattctacgattcagcaaaggcgggagacgccctgcccaaggacgcggatgctaacggcgcatactgtattgccctgaaaggcttgtacgagataaaacagatcacggagaactggaaagaagatggaaaattcagtcgtgacaagttaaaaattagtaacaaagactggttcgactttattcagaacaagagatatctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 98 - DNA, 3960 bp, Artificial Sequence
  Description of Artificial Sequence: Synthetic polynucleotide
ccagcggctaaaaaaaagaaactggatggcagcgtggatatgaacaacggaaccaataactttcaaaactttataggcatctccagtctacagaagacactacgtaacgctttgataccaactgagaccacgcagcagtttatcgtcaagaacggtattataaaggaagacgagctaaggggggaaaaccgtcagatcttaaaggacatcatggatgactactacagaggcttcataagtgagactttgtctagtatagacgacatcgactggaccagtttatttgagaagatggaaattcagttaaagaacggggacaataaagacacactaattaaagagcagaccgaatacagaaaagctatacacaaaaagtttgccaacgatgatagattcaaaaatatgttttcagcaaaattgatttccgacatattgccagaattcgtaatccataataacaattattctgcaagtgagaaggaagagaagacccaagtaatcaagctgttttcccgttttgctacgagtttcaaagattatttcaagaatagggctaattgtttctccgcggacgacataagtagcagttcctgtcacaggattgtgaacgataatgctgagatatttttttccaatgccctagtgtataggagaatagttaaaagcttaagcaacgacgatatcaataaaatttcaggggacatgaaggacagcttaaaggaaatgagtttggaggagatttacagttatgaaaaatacggagagtttataactcaggaaggcatctctttctataatgatatctgtgggaaggtaaactccttcatgaatttatattgccagaagaataaggaaaacaaaaatctttacaagcttcaaaagttacataagcagatcttatgtattgccgacacgagttatgaagtgccttataaattcgagagtgatgaggaagtgtatcagtctgttaacggattcctagataatataagttccaaacatatagtcgagaggctgaggaagattggcgataactataatggatataatcttgacaaaatctatatagtctctaaattttatgaaagcgtcagccagaagacatatagagattgggaaactataaacacagcccttgaaatacattacaataacatcctacccggcaatggtaagtctaaggcagacaaagttaaaaaagcagtaaagaatgacttacagaagtcaatcacggagataaatgagttggtcagtaactacaaattatgctccgacgataatattaaggccgaaacatatatacacgagataagtcatatattaaacaatttcgaagcccaggagttaaaatataaccctgaaattcatctggtcgaaagtgagttaaaggccagtgagttaaagaatgtacttgacgtaattatgaatgcttttcattggtgctccgtgttcatgaccgaggagttagtagataaagacaataacttttacgccgaacttgaagagatatacgacgagatttatccggtaatcagcttgtacaacttagttagaaattatgtaacacagaagccttactctactaaaaaaataaaactgaactttggtatcccaactcttgcagatggttggagtaaaagcaaggaatatagcaacaatgcgatcatcttgatgagagacaacttgtactatttgggaatcttcaacgcgaaaaataaacccgacaaaaaaatcatcgaagggaatacctctgagaataaaggtgactataagaaaatgatttacaatctacttcctggtcctaataaaatgatcccgaaagtgtttcttagttctaagactggtgtcgagacgtacaaacctagcgcgtacatcttagaagggtacaagcagaataaacacatcaaatcaagcaaagacttcgatattactttttgccatgacttgatagactactttaaaaactgcatagcaatccacccggagtggaaaaactttggctttgatttctctgacacctctacatatgaggacatatctggtttttaccgtgaggttgaattgcagggatacaaaattgactggacttacatatctgaaaaagatatcgatctattgcaggagaaaggccagctttaccttttccagatctataataaggacttctctaagaagtctacagggaatgataatttgcacactatgtacttaaaaaatctgttttccgaggaaaacttgaaagacattgttttaaagttgaacggagaagctgaaatatttttcagaaagagctccataaaaaacccgatcattcataagaagggatctatcctggttaacagaacgtacgaagcggaagaaaaagaccaattcggaaacattcaaattgttagaaagaatatccctgagaacatctaccaggagttatataagtattttaatgataagtcagataaggaactatctgacgaagcggcgaagcttaaaaatgttgtaggacaccatgaggctgctacaaatatagtcaaggactaccgttatacctacgataagtactttctacacatgcccattaccatcaattttaaagctaataaaacgggttttatcaacgatcgtatcctacaatatattgcgaaagagaaggatttgcatgtcattggcattgatagaggtgagaggaacctaatatacgtatccgtgattgatacgtgcgggaacatagttgaacagaaatcatttaatatagttaatgggtacgactatcagattaagctaaagcaacaagaaggcgccaggcaaattgcccgtaaagaatggaaagagatcgggaagatcaaggaaataaaagaaggatacctttccctggtcatccatgaaattagcaaaatggtgattaagtacaatgccataatcgcgatggaggacttaagctacgggttcaaaaaggggaggtttaaggtggagaggcaagtgtaccagaaatttgagaccatgctaatcaacaaactgaactacctagtttttaaggacatttcaattacagagaatggaggacttttaaagggttaccaactaacgtatataccagataagttgaaaaatgtcggtcaccagtgtggctgcatcttttacgttcccgccgcttatacatctaaaattgatccaaccacaggctttgtaaatatctttaaattcaaagatttaactgtggatgcaaaaagagagtttatcaagaaattcgatagcattcgttatgatagcgagaagaacctgttctgctttactttcgactataacaactttataactcaaaacaccgtgatgtcaaaaagctcatggtcagtctacacctatggtgtaaggattaaaaggcgtttcgtgaatgggagattctccaatgaaagtgacacgatcgacataacaaaggacatggagaagacactagagatgactgatattaattggagagacggacacgatctgcgtcaagatataattgattatgagatagtacagcacatatttgagatcttccgtttgactgtccaaatgcgtaattccctttctgagctggaagatagggactatgatagattaatatcccctgtactaaatgagaacaacattttctatgatagtgcaaaagccggggatgcattgccgaaagacgctgacgctaatggggcgtactgtatagctttaaaggggctttacgaaataaagcagataaccgaaaactggaaggaagatggcaaattctcaagggacaaacttaagatctctaacaaggattggttcgattttatacaaaacaaacgttatttgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 99 - DNA, 3960 bp, Artificial Sequence
  Description of Artificial Sequence: Synthetic polynucleotide
ccagcggctaaaaaaaagaaactggatggcagcgtggatatgaataatggtacaaacaactttcagaatttcattgggatctctagcttacagaagaccctgaggaatgcgttgattccaactgaaacaacccagcaattcatcgtgaaaaatgggataatcaaagaggatgagttaaggggtgaaaaccgtcaaatattgaaggatattatggacgactactaccgtggattcatctcagagacgttgagcagcattgacgacatagactggactagccttttcgagaagatggaaattcagttaaagaacggagataacaaagatacactaatcaaggaacagacagaatacagaaaagcaattcataagaaattcgctaatgacgatcgttttaaaaacatgttctctgcaaaattaattagcgacattctgccggaattcgttatacataataataactacagtgcttctgaaaaggaagagaaaactcaggtaataaaactgttctctcgttttgccacatccttcaaagactactttaaaaatagagcgaactgctttagcgccgacgatattagttcttcctcatgccacaggattgtcaacgataatgcagagatattcttttctaacgcactagtctacagaaggattgtaaagtctttgtcaaatgatgacataaacaagattagtggagatatgaaagactctctaaaggaaatgagccttgaggagatatactcttatgaaaagtacggtgagtttattacccaagaaggcattagtttctataatgacatttgtggaaaagttaacagttttatgaatctatactgtcaaaaaaataaggagaataaaaatctttataagttgcaaaaactgcataagcagatattatgtatagcagacacgagctatgaggtaccgtacaagttcgagagcgatgaggaagtctaccaatctgtcaacggatttttggacaacatttcttcaaaacatattgtggagaggcttaggaaaataggcgacaattataatggatataacttagataagatatatattgtttccaaattctacgaatctgtaagccagaagacatacagagattgggaaacgataaacacagcccttgaaattcactataacaacatactacctggaaacggcaaatcaaaggccgacaaagttaagaaggccgtaaagaatgatttacagaagagcataacggagatcaatgagctggtgtctaactataaattgtgtagcgatgacaacataaaagccgagacttacattcacgaaatttcacacatacttaacaactttgaagctcaggaattaaagtataatcccgaaatacaccttgtggagtccgaactaaaggctagtgagcttaagaacgtcctagacgtaattatgaatgccttccactggtgtagtgtttttatgaccgaggaacttgttgacaaagataataatttttatgcagaactagaagagatatacgatgaaatatacccggtgatcagtttgtacaatcttgtcaggaactatgtgacacaaaagccctattcaacaaagaaaataaaacttaatttcggaattcctacgttagctgatggctggtctaaatccaaggaatacagcaacaacgctataattctgatgagagataacttgtactatctaggcatcttcaatgccaaaaataagcctgataagaagattatagagggcaacacttcagagaacaagggcgactacaagaaaatgatctataacctattgcctggcccaaacaagatgattccgaaggtcttcctatcatccaagaccggcgttgagacatacaagccatcagcgtatattttagaggggtacaaacaaaacaagcacataaagtctagtaaagacttcgatataacattttgtcatgacttaattgactactttaagaattgcatcgctatacacccggaatggaagaatttcggcttcgacttctctgatacatctacctacgaggacattagcgggttttaccgtgaagtcgaattacaagggtataagatagattggacgtacatctctgagaaagacatagacttgcttcaggaaaagggccagttgtatctattccaaatatacaataaggatttttccaagaaatctacgggtaatgacaatcttcacacaatgtatcttaagaaccttttctcagaagagaacctgaaggacattgtcttaaaactaaatggcgaagctgagatttttttcaggaagtcttcaattaagaacccgataatccacaagaaggggagtattcttgtgaatagaacttacgaggccgaagaaaaagaccaatttggtaacatccagatagtcagaaagaacattccagagaacatctaccaagagctatacaaatatttcaacgacaagtccgataaggaactgtccgatgaggcagccaagttgaagaatgtcgtgggtcatcatgaagctgctactaacattgtcaaggactatcgttatacttacgacaagtatttcctacacatgccgataacaattaatttcaaggctaacaaaacaggctttatcaacgatcgtatcttgcagtacatagctaaggaaaaggatttgcatgtgattggcattgatagaggggagcgtaacttgatatatgtgtctgtcatagacacgtgtggcaacatcgtcgaacagaaatcattcaacatagtaaacggctacgattaccaaattaagctgaaacagcaagagggtgcacgtcaaattgcgcgtaaagagtggaaagaaattggtaaaatcaaggaaattaaagaaggctacttgtctcttgttatacatgaaatttccaagatggttataaagtataacgcgataattgctatggaagacttatcatacgggtttaaaaaggggaggttcaaggtagagaggcaggtctatcaaaagttcgagacgatgttgattaataaactaaactatctagtgttcaaagatatcagcattacggagaacggggggctactgaaaggatatcaactaacgtacattcccgataagttaaagaacgttggtcatcaatgtggttgcatcttctacgtgcctgctgcctatacgtccaaaatagatccaactactggatttgttaacatctttaaattcaaagatttaaccgtagacgccaaaagggaatttataaaaaaatttgacagcatccgttacgatagcgaaaagaatctgttctgttttactttcgactacaataatttcatcacgcaaaatacggtaatgtctaagtcaagttggagcgtctacacgtatggagtcaggatcaagaggcgtttcgtaaatggaagattctctaatgagtcagatactatagacatcacgaaagatatggagaaaaccttggagatgacggatattaactggcgtgatggacacgatttaagacaggacattattgactatgagattgtgcaacacatcttcgaaatattccgtctaacagtccaaatgaggaatagcctaagtgaattggaggaccgtgattacgataggcttataagtcctgtccttaacgaaaacaatattttctatgatagtgctaaggcgggggacgcactgcctaaagacgcagatgctaacggggcatactgcattgcgttaaagggtctgtacgaaatcaagcagattacggaaaactggaaagaggatggcaagtttagcagagataagttgaagataagtaacaaagattggtttgactttattcagaataaaaggtatttaaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 100 - DNA, 3960 bp, Artificial Sequence
  Description of Artificial Sequence: Synthetic polynucleotide
ccagcggctaaaaaaaagaaactggatggcagcgtggatatgaataacggcactaataatttccagaatttcatcggcattagcagcttacaaaagacgttgaggaatgccttaatacccacagaaactactcaacaatttatagtgaagaatgggataattaaggaagacgagttgagaggtgaaaataggcaaatcttgaaagacattatggatgactactacaggggcttcattagtgaaacgttgtcttcaatagatgacattgattggacttctttgtttgagaagatggaaatacagttaaagaacggcgacaataaggatacacttatcaaagagcaaacagaatatagaaaagcaattcacaaaaagtttgctaacgatgataggttcaagaacatgtttagcgctaaactaatatcagacatccttcccgagttcgttattcataacaataactatagtgcaagtgaaaaagaggagaagacacaggtgattaagctgttctccagattcgcgacttctttcaaagattacttcaaaaacagagccaactgtttttcagctgacgatatctctagtagtagttgtcaccgtatagtgaacgataacgctgagatcttctttagcaatgcattagtgtatagaaggatagttaagtctctaagcaatgatgatatcaataaaatttccggagacatgaaggactccctaaaggaaatgtccttagaagagatctactcatatgagaaatacggggaatttattacgcaggaagggatctccttttacaatgacatatgcgggaaggtcaactctttcatgaacttatactgccaaaagaacaaggagaacaagaatttatataaacttcagaaacttcacaaacaaatactgtgcatagccgatacctcatatgaggttccttacaaatttgaatcagatgaagaggtataccaatccgttaacggctttcttgacaatattagctcaaagcacatcgtggagaggttgagaaagattggtgataattataatggctacaatctagataagatatatattgttagcaagttctacgagtctgtgtcccaaaaaacatatagggattgggagacaattaatactgctctagaaatccattacaacaacatccttcctggaaatggcaagagtaaggccgacaaagtcaagaaagcagtgaaaaatgatctgcaaaaatcaattactgagataaacgagctagtatctaattacaagctttgtagcgacgataacattaaggcagaaacgtacatacacgagattagtcacatcttaaataattttgaagcccaagaactgaaatataaccctgagatacaccttgttgaatccgagttaaaggcgtctgaactaaaaaacgtgttagacgttattatgaatgccttccactggtgtagcgtctttatgactgaggagttggttgataaggataataacttttacgctgaattggaagaaatttatgacgaaatctatcctgttatttctctatataatttggtgagaaattacgtaacgcaaaagccctatagtacgaaaaaaataaaactaaatttcgggatccctaccctagccgacggttggtctaaatccaaggagtactcaaacaatgcaataatattgatgagggacaacctgtactacctaggcatatttaatgccaaaaataagcccgataaaaagattatagaagggaacacgtcagaaaataaaggagactataagaaaatgatctacaaccttttgcccggccccaataaaatgatcccgaaggtcttcctaagtagcaagactggcgtagagacctacaaaccatctgcatacattttggaggggtacaagcaaaacaagcacataaagagtagtaaggattttgacattacattctgccatgacttaattgactactttaaaaattgcatcgcaattcaccctgaatggaaaaattttggatttgatttctctgatacttcaacatatgaggatatttcagggttctacagggaggtcgaactacagggttacaaaatagactggacgtatatttctgagaaagatatagatttgcttcaggaaaagggtcagctatatctgttccagatatataataaggacttctccaaaaagagtaccggaaatgataatctgcacacaatgtacttaaaaaacttgttctctgaggagaatctaaaagacatcgtactaaaacttaacggggaggccgaaattttttttaggaagtccagcatcaagaacccgattattcataaaaaaggtagcattttggtgaaccgtacttatgaggcggaagaaaaagaccaattcggtaatattcaaatcgttagaaagaacatccctgagaacatttatcaggaactatacaaatactttaacgacaaatcagataaggagctttctgatgaggcagctaaattgaaaaatgtagtgggacatcacgaagcagccactaacatagtgaaggactacagatacacatacgataagtacttcctgcacatgcctattacaattaactttaaagcaaataaaacagggtttattaacgacagaatcttacagtatattgccaaagaaaaggatctgcatgtgataggaatagacagaggagaaagaaacctgatatacgtctccgtgattgatacatgtgggaacatagtagaacagaagtcctttaacattgttaatgggtacgattatcaaattaaattaaaacaacaagaaggagcacgtcaaatagctaggaaagaatggaaagagataggaaaaattaaggaaattaaggagggttacctgtcccttgtaattcatgaaatatccaaaatggtaattaaatataacgcgatcatcgcgatggaagatctaagctacgggttcaaaaaaggcaggtttaaggtggagaggcaagtttaccaaaagttcgagacaatgttgattaataagttaaactacttagttttcaaagatatctccataaccgagaatggcgggcttttaaaagggtaccaactaacatatatcccggataaattgaagaacgttggacaccagtgtggctgcatattttatgtacccgctgcgtatacttctaaaattgacccgaccaccgggtttgtaaacatattcaagtttaaggacctaacagttgacgccaaacgtgagttcatcaagaagttcgatagtataaggtatgactctgagaagaaccttttctgcttcacgtttgactataataatttcatcacccaaaatacagttatgtcaaaaagctcttggtcagtatatacgtatggcgtaaggattaagcgtaggttcgtgaacggtagattttccaacgagtcagatactattgatattaccaaggatatggagaagacattagaaatgacagatataaattggagggatgggcacgatctaaggcaagatatcattgattacgaaattgttcagcacatattcgagatattccgtcttacagtacaaatgcgtaacagcttgtctgagttggaagatcgtgactatgacaggttgatatcaccggtcttgaacgagaacaatatattctacgacagcgctaaggcgggagacgctctgcctaaagacgcagatgccaatggggcgtactgcattgccttaaaaggcttatacgagattaaacagatcacagagaactggaaagaggacggcaagttttctagagataaattgaaaatctcaaacaaagactggttcgatttcatccaaaacaaaagataccttaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 101 - DNA, 3960 bp, Artificial Sequence
  Description of Artificial Sequence: Synthetic polynucleotide
ccagcggctaaaaaaaagaaactggatggcagcgtggatatgaacaatggaactaacaacttccagaactttatcggcatctcttccctccaaaagacactgagaaatgcactgatcccaaccgaaacgactcaacaatttattgttaagaacggcatcataaaagaagacgagcttcgcggcgagaaccgccagatacttaaggatattatggacgattattaccgaggctttatcagcgaaactcttagctctattgatgatatcgactggacctccctcttcgaaaaaatggagatacagctcaagaacggcgataataaagacaccttgataaaggaacagactgagtacaggaaagcgatccacaagaaattcgcgaacgacgacaggtttaaaaacatgttctctgcaaaattgatatccgacatcttgccggaatttgtgatacacaacaataactatagcgcttcagagaaagaagagaagacccaagtaatcaagttgttcagccgcttcgcaacgtcttttaaagattactttaagaaccgggccaattgtttctccgcggatgatattagctcatcaagttgccatcgaattgtcaatgataatgcggagatcttcttcagcaatgcgctggtctacagacgaatcgtaaaaagtctttcaaatgacgacatcaataagattagtggagatatgaaggattcccttaaggaaatgagtcttgaagaaatatactcatacgaaaagtacggggaatttattacccaggaggggatctccttctataacgacatctgtggaaaagtaaactcattcatgaacctgtactgtcagaaaaacaaagaaaacaaaaatctgtataaactccaaaaattgcacaagcaaatattgtgtatagcggacacatcatacgaggttccatataagttcgaaagtgatgaagaagtctaccaatcagtgaatgggtttctggacaacattagttccaagcacatagttgaacgactgcgaaagattggtgacaattacaacggctataatttggacaagatttatatagttagcaaattttatgaatccgtatcacaaaagacttatagagactgggaaacaatcaacacggcacttgagatccattataacaatattcttccagggaacggcaaaagcaaggctgataaggtaaaaaaggccgttaagaatgatcttcaaaaatccataacggagatcaacgaacttgtaagtaactacaaattgtgctctgacgacaatataaaggctgaaacgtatattcacgagattagccatatcctgaataactttgaggcccaagaactcaagtataacccggaaatacatttggtagaaagcgagcttaaagcgagtgagctgaaaaacgtcctcgatgtgatcatgaatgctttccactggtgtagtgtctttatgactgaggagttggttgataaagacaataatttctacgctgaactggaagaaatttacgacgaaatctatccagtgatctccctctataacctcgttcgaaactacgtgacgcagaaaccttattctacaaagaaaattaagttgaacttcggcattcctacacttgctgacggatggtccaaatccaaagagtactcaaacaacgcaatcatcctcatgcgggataacctttattatttgggcattttcaacgccaaaaacaaacctgataaaaagataattgaaggcaatacgagtgagaacaagggcgactacaaaaaaatgatatataacttgttgccaggccccaacaagatgattcctaaagtttttctgtcttctaagactggagttgaaacttacaaaccctccgcctacattcttgaagggtataaacagaataagcacataaagtcctcaaaggatttcgacattacgttttgccatgacctcatcgactatttcaagaactgtatcgccatacatccggagtggaagaattttggatttgatttctccgacacatctacctatgaagacataagcggtttctaccgggaggtcgagcttcagggctataagatagattggacatacattagtgaaaaagatatcgatcttctgcaagaaaagggacaactttacctttttcagatttataataaagacttttcaaaaaagtccacagggaacgataatctgcacaccatgtatctcaagaatctgtttagtgaagaaaaccttaaagacatagttttgaagcttaacggagaggctgagattttttttagaaagtcctcaattaaaaaccctataatacacaagaaaggctctattcttgttaacaggacatatgaagccgaggagaaagatcagtttggcaatatccagattgttcgcaagaatatcccggaaaatatatatcaggagctgtataaatactttaacgacaagagcgacaaggagctgagtgacgaggccgcgaagcttaagaatgtagtaggtcaccacgaagcagccaccaatatcgtcaaagactataggtacacgtacgacaagtactttttgcacatgcctataactataaacttcaaagctaataaaactgggtttattaatgacaggattctccaatacatcgctaaagagaaggatctgcatgtaattggcatagacagaggtgagagaaacttgatatatgtcagcgtaatagacacatgtggcaatatcgtggaacagaagtcttttaacatcgtcaatggttacgactaccaaattaagttgaaacagcaggaaggcgcacgacagatcgcacgaaaggaatggaaagagataggcaaaataaaagaaataaaggagggctatctcagtctcgttatacacgaaatttcaaaaatggttattaagtacaatgcaatcatagcgatggaggatctcagttatgggttcaaaaagggtcggtttaaagttgagcgccaagtgtaccaaaagttcgagacaatgctgattaacaagctgaactacctcgtcttcaaagatataagtattacggagaacggtggccttcttaaaggctatcaacttacttacatcccggacaagctcaaaaacgtagggcaccaatgcgggtgtattttctatgtgcctgcggcatatacgtcaaagattgacccaaccacaggattcgtaaacatattcaagtttaaggacctcaccgttgatgcgaaaagggagttcattaaaaaatttgattctattcgatatgatagtgagaaaaatctcttttgtttcacatttgactataataattttattactcagaatactgtcatgagcaagtcatcttggtcagtgtacacatacggggtgcggatcaaacgcaggttcgtcaatggtcgcttctcaaacgaatcagacaccattgacatcacaaaggacatggaaaaaacccttgagatgaccgacattaattggcgcgatggtcatgatctgcggcaagacatcatagactacgaaatcgtccaacacatctttgagatctttcgcttgacggtccaaatgcggaactccctgtccgagctcgaggatagagattatgatcggctgatatctcccgtgcttaatgaaaataacatcttctacgactccgccaaggcgggtgatgccctgccgaaggatgcggatgctaatggcgcttattgcattgctcttaaggggctctatgagataaagcagatcacggaaaactggaaagaagacggtaagtttagtagagacaagctgaagatctcaaataaagactggtttgatttcatacagaacaagcggtacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 102 - DNA, 3960 bp, Artificial Sequence
  Description of Artificial Sequence: Synthetic polynucleotide
ccagcggctaaaaaaaagaaactggatggcagcgtggatatgaacaatggcactaacaattttcagaatttcatcggcatttcaagtctgcaaaaaactctgaggaatgctttgatccctactgaaaccactcagcaatttatagtcaagaacggtataattaaagaagatgaactcaggggtgaaaatagacaaatactcaaggacattatggatgactattatagaggcttcatctcagagactctctcatcaatagatgatatcgattggactagccttttcgagaaaatggagattcagttgaaaaatggtgataacaaagatacgttgataaaggaacagaccgagtacaggaaagccattcataagaaatttgctaatgacgatagatttaagaatatgtttagtgcaaaactgattagtgacattctgccggagttcgttatccataataataactactctgcatccgaaaaggaggaaaagacgcaagttattaaactgttcagccgcttcgccacaagcttcaaggactacttcaaaaatagagccaactgcttttctgccgacgatatatcatcatcttcatgccatcggatcgttaacgataacgccgagatattcttcagcaacgcccttgtatatcgaagaatagtcaaaagtctgagtaatgatgatattaataaaattagcggtgatatgaaagactccctgaaggaaatgtcactggaggaaatttatagttacgaaaagtacggcgaattcattactcaagaaggcatatccttctataacgacatttgcggaaaggtcaactcattcatgaacctttattgccagaagaataaggagaataaaaatctttacaaattgcaaaaacttcacaaacaaattctttgcatcgcggatacgtcctacgaagttccttacaaatttgaatccgatgaggaagtgtatcagagtgtcaatggatttttggataatatctcttcaaaacatattgtggagagattgcgcaaaataggtgataactacaatggctacaacctggacaagatttatattgttagcaagttctatgaaagtgtcagtcaaaagacctacagagattgggagacaatcaacacggcgctcgaaatacactacaataacatcctccccggcaatgggaagagtaaagccgataaggttaaaaaagctgttaagaacgacctccagaaatccatcacggaaataaacgagctggtttccaactataagctgtgtagcgatgataatattaaggctgagacatatatacatgagatcagccacattctcaacaatttcgaggcacaggaactcaaatacaatcccgagattcacttggtggaaagtgagttgaaggcgtcagagcttaagaatgtacttgacgtaataatgaatgcttttcattggtgctccgtgttcatgactgaggaactcgtggataaggataataacttttatgcggagttggaagagatatacgatgaaatatacccggttatctcactgtataatctggtcagaaattacgtgacccaaaagccttatagtacaaaaaaaataaagttgaacttcggtattccgacattggcagatggttggtccaaaagcaaagaatactctaataacgccattatattgatgcgagacaatttgtattaccttgggatctttaacgcgaaaaacaaaccggataagaagatcatcgaaggtaatacatctgagaataagggggattacaagaagatgatttataatctgttgccggggccaaacaagatgattccgaaggtctttctgtcatctaagacaggagtagagacctacaaaccttctgcgtacattttggaaggctacaaacagaacaagcatataaaatctagcaaggactttgatatcacgttttgtcatgatctgatagattatttcaaaaactgcatcgctatacatcctgagtggaagaatttcggctttgacttttctgacaccagcacatacgaagacatctcaggtttctaccgggaagtcgagctccaggggtacaagattgactggacatatataagtgaaaaagacatcgacctcctccaagagaagggccaactttacctgttccagatctataacaaagacttttctaaaaagtccacgggtaacgacaacttgcacactatgtatctgaaaaacttgttctctgaagagaacctcaaggacatcgtcctgaagcttaacggggaggcggagatcttctttagaaagtcctctatcaaaaatcccattatccataaaaagggctctatactcgttaataggacatatgaagcggaggaaaaagatcaatttgggaacatccagatcgtccggaaaaatatacctgagaatatctatcaagagctgtacaagtattttaatgataagtcagacaaagagctcagtgatgaggcggcaaagctcaagaacgtggtggggcatcatgaagctgcgacgaacattgtcaaagattatagatacacttacgataaatacttcctccacatgccgataacgattaacttcaaagccaataagacggggtttataaatgatcggatccttcagtacattgcgaaagagaaagacctccatgtgatcggaattgaccgaggagaaaggaatctgatttacgtgtccgtgattgatacttgcgggaatatagtcgagcaaaagagtttcaacatagtcaacgggtatgactatcagataaagctcaaacagcaggaaggtgcgaggcaaattgcgcgcaaagagtggaaggagataggcaagattaaagaaatcaaggaaggttatctcagcttggtgatccatgaaatatctaagatggttataaagtacaatgccataatagccatggaggatctttcctacgggtttaagaagggccgatttaaagtggagcgacaagtttaccagaagttcgaaaccatgttgattaacaaacttaactatttggtgttcaaggatataagtataaccgaaaacggcggtttgcttaagggttatcagctcacgtatattcctgataaacttaaaaacgttggacaccagtgtggatgtatcttctacgtgccagccgcttacactagtaagatagatcctaccacggggtttgtgaatatttttaagtttaaagacttgacagtcgacgccaaaagggaatttataaaaaagtttgattctatccgctacgatagtgaaaaaaatctcttttgctttactttcgactataacaacttcattacgcagaacactgtcatgagtaagtccagctggagcgtctacacatatggcgtccgaattaaacgacgatttgtaaacgggcggttttcaaacgaatctgacacgatagacattaccaaggatatggagaagacacttgagatgaccgacataaactggcgggacggtcacgatcttcggcaggacataattgattacgaaatcgtccagcatatattcgaaatatttcgacttacagtgcaaatgcggaacagtctctctgaactggaagatcgcgattatgaccggttgatttctccggtcctcaatgaaaataacatattttatgatagtgctaaggcaggtgatgcgttgccaaaggatgcagacgctaatggtgcctattgtatcgcgctcaagggattgtacgagataaagcaaattacggagaactggaaggaggatggtaagtttagccgagacaagttgaagattagcaataaagactggtttgattttatccaaaacaagaggtacctgaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 103 - DNA, 3960 bp, Artificial Sequence
  Description of Artificial Sequence: Synthetic polynucleotide
ccagcggctaaaaaaaagaaactggatggcagcgtggatatgaataacggaactaataactttcaaaatttcataggtatttcaagcttgcagaagaccctgaggaatgccctgattccaaccgagacaacgcagcagttcatagtcaaaaatggcattattaaggaagatgagctgcggggggaaaaccgacagatactcaaggatattatggacgactattaccggggatttatctcagaaacgctgagcagtattgatgacatcgattggaccagtcttttcgagaaaatggaaattcaacttaagaatggtgacaataaagacactctcataaaggagcaaactgaataccgaaaagccatacacaaaaagtttgccaacgatgaccgctttaaaaacatgttttcagctaagctcattagcgacattctccccgagtttgtgattcataacaataactatagcgcatccgagaaggaggaaaaaacccaagttatcaaattgttcagtagattcgctacgagctttaaagattactttaaaaaccgggctaactgcttcagtgcagacgatatcagctcctcatcctgtcatcgcatcgtcaatgataatgctgagatcttcttttctaatgcactggtttaccgcaggatagttaagtctcttagtaacgacgacatcaacaagatatcaggagatatgaaggattcccttaaagaaatgagtctcgaggagatatattcttatgaaaaatacggcgaatttattacccaagagggcattagtttctataatgacatatgcggaaaagttaatagttttatgaatctctattgtcagaagaataaggagaataagaacctctacaaattgcagaagttgcacaagcaaattctgtgtatcgcggacacctcttacgaggtcccatataagttcgagagtgatgaagaagtataccagagcgttaatgggttcctggacaacatctcaagtaaacacatagtcgaaaggctccgaaagatcggtgataactataacggatataatttggataaaatttatatagttagcaaattttacgagagcgtcagtcagaagacctaccgggactgggagaccataaacacagcgctggaaatacattataacaacatactgcctgggaacggtaagtcaaaggcagacaaggttaaaaaggctgtgaagaatgacctgcaaaaatcaattacagaaataaatgagttggtaagtaattacaaactttgcagcgatgataatataaaggcagagacgtacatacatgaaatatctcatatcctcaacaatttcgaagcccaagaactgaagtacaacccggaaattcatcttgtagagtctgagttgaaggcctccgaattgaaaaacgttcttgacgtaattatgaatgccttccactggtgctcagtattcatgacggaagagctcgtggataaagacaacaatttttacgctgaactggaagaaatatatgacgagatttaccccgtaatttcactctacaacttggtacgaaattacgttacccaaaagccatactcaacaaaaaaaattaaactgaacttcgggatacccaccctcgcagatggatggtcaaagtccaaagagtacagtaacaatgcaattatcctgatgcgagacaacctttattacctcgggattttcaacgctaaaaataaacctgataaaaaaataattgagggtaatacctctgaaaacaagggggattataaaaagatgatatacaatctgctgcctggcccgaacaaaatgattcctaaagtcttcttgtcttccaagactggagtcgaaacctacaagccaagtgcttatatactcgaagggtacaaacaaaataagcacataaaatccagcaaggattttgatattacattctgccacgatttgattgattattttaagaactgtatagccatccacccagaatggaagaattttggttttgattttagcgatacctcaacatatgaggatatctctggcttttaccgcgaggtagaactgcaaggttataagatcgattggacttatatttctgaaaaggacatagatctcctgcaagagaaagggcaactttatttgtttcaaatatacaacaaagattttagtaagaagagtactggcaatgataaccttcacactatgtatctgaagaaccttttttctgaggagaacttgaaggacatagtccttaaactcaatggggaagctgaaatattctttcgcaaaagctccattaaaaacccgatcattcataaaaagggttccatcttggtaaaccgcacatacgaggcggaagaaaaagatcagttcggaaatatccagatcgtaaggaagaatatccccgaaaatatataccaagagctttacaaatattttaacgataagtcagacaaggaactgtcagacgaagcagccaagttgaagaatgtcgtagggcaccacgaagcagctacaaacatagttaaagattatcggtacacctacgataaatatttcctgcatatgccaataaccataaacttcaaagccaacaaaacagggttcatcaatgaccgaatacttcagtatatagccaaggaaaaagacctgcatgttataggaatagatagaggtgagcgcaacttgatatatgtcagcgtgatagacacctgcggaaatatcgtcgagcaaaaaagtttcaacattgttaatggctacgattaccaaattaaattgaagcagcaagagggggctcggcaaatcgcgcgaaaggaatggaaagaaatcgggaagattaaagaaattaaagagggctacctgtctcttgtaattcacgaaatatctaagatggtcatcaagtataatgccattattgcgatggaagatctgtcctacggatttaagaaaggcaggtttaaagtcgaaaggcaggtgtaccagaaattcgagaccatgctgattaataagctcaactatctcgtatttaaggatatttctataactgaaaatggagggcttctcaaaggatatcaactcacatacatacctgataagctgaagaacgtaggccaccagtgtggatgcatattctatgtaccagctgcatacacaagcaagatcgatccaactactgggtttgtcaatatcttcaaatttaaggacttgacggtcgatgccaaacgggagttcatcaaaaagtttgatagtattcgatatgatagtgagaagaacttgttttgcttcacatttgactacaacaatttcataacgcaaaatacggttatgtctaaatcctcatggagcgtctacacttacggagtgaggataaagcggcgcttcgtaaatggcaggtttagcaatgaatccgacacgattgacataaccaaggatatggagaaaaccctcgagatgaccgatataaattggcgggatggacacgatctgcgacaagacataatcgattatgaaatcgtgcagcacatatttgagatattcaggcttacggtccaaatgagaaattccctttccgaacttgaagaccgcgattacgaccgactgataagccccgttctgaacgaaaataacatcttctacgacagcgctaaagcgggagacgcgctgccgaaagatgcggacgcaaatggagcctattgtatcgccttgaaagggttgtacgagatcaaacagataaccgagaattggaaggaggatgggaagtttagtcgagacaaacttaaaataagcaacaaggactggttcgactttattcaaaacaaacgatatctcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 104 - DNA, 3960 bp, Artificial Sequence
  Description of Artificial Sequence: Synthetic polynucleotide
ccagcggctaaaaaaaagaaactggatggcagcgtggatatgaataatggtactaacaattttcaaaactttatcggcatctcttcacttcagaaaactcttcggaacgcccttataccgacggagacaacgcagcagtttatagttaaaaacgggatcattaaagaagatgaactcagaggggaaaacaggcaaatattgaaggacattatggacgattactaccgggggtttatttcagagaccctttcatctattgatgacatagattggacctcccttttcgagaaaatggagatacaattgaaaaacggcgacaataaagatacacttatcaaggaacaaactgagtatcgcaaggcgattcacaagaagtttgcgaatgacgatcgctttaagaatatgttttctgcgaagctcataagtgacattctgcctgaatttgtcattcataacaacaattattctgctagcgaaaaagaggaaaaaactcaagtcattaagctttttagcaggttcgctactagttttaaagactattttaagaaccgggcgaattgctttagcgctgacgacatatcatcctcatcctgtcatcgcatagtcaatgataatgcagaaatattcttttctaatgcgctcgtgtatcggagaatagtgaaaagcctctctaacgatgacattaacaaaataagcggcgatatgaaggatagtctgaaggaaatgtccctcgaagaaatatactcatacgagaagtacggagaatttatcacccaggaaggaattagtttttacaacgacatctgtggtaaggttaactcttttatgaatctgtattgtcaaaagaataaagaaaataaaaatctttataagctccaaaagcttcacaaacaaatcttgtgcattgcggatacgtcatacgaagtaccttacaaatttgaaagcgacgaagaggtgtatcagtcagtgaatgggttccttgacaatatttctagcaaacatattgtggagcgacttcgaaagatcggtgataattacaatggctataatttggataaaatttacatagttagtaagttttatgaatccgtctcacaaaagacgtaccgagattgggagaccatcaacactgctctggagattcattacaataatatattgcctgggaatgggaagtcaaaggccgacaaggttaaaaaagccgtaaaaaacgatcttcaaaagtccattaccgagataaatgaacttgtatccaactataagttgtgctctgacgataatattaaagcagaaacgtatatccacgaaataagtcacatcctgaacaacttcgaagctcaagagctcaagtataatcctgaaattcatctcgtcgaaagcgagctgaaagcatccgagttgaagaatgtgcttgatgtgatcatgaacgcattccattggtgcagtgtgttcatgaccgaagaacttgtagacaaagacaacaacttctacgctgaattggaagagatttacgatgaaatttaccccgtgatatccctctataatctggtaagaaattacgtcacgcaaaaaccatacagtaccaagaaaataaagctcaactttggtattccgacgttggcagatgggtggagtaagagcaaggagtattctaacaatgcaatcatcctcatgcgcgacaatttgtattatctggggatcttcaacgcgaaaaataagcccgacaaaaagataatagaaggcaatacgtccgagaacaaaggggactataagaaaatgatttataaccttcttccaggacccaacaagatgatcccaaaggttttcttgagttcaaaaaccggcgtagaaacttataaaccgtccgcctacattctggaagggtacaagcaaaacaagcacattaagtcatctaaggatttcgacattactttttgtcatgatttgatagactacttcaaaaattgtatagcgatacatccggaatggaaaaattttgggttcgatttttccgacacaagtacttatgaagacatctcagggttttatagggaagttgaactgcaaggttacaaaatagactggacttatattagtgagaaggacattgatttgctccaggaaaagggtcaattgtatctgttccagatatataacaaggatttctctaaaaaatctacaggtaacgacaatctccacacgatgtacctcaagaatctcttcagcgaagagaatttgaaggatatcgtacttaagctcaatggagaagcggaaatattcttcagaaagtccagcattaagaatcctataattcacaagaaagggtcaattctcgtaaaccggacttatgaggccgaagaaaaagatcagtttggtaacattcagattgtacggaaaaacattcccgagaacatctatcaagaactgtataaatactttaatgataaatccgacaaggaactttctgacgaggctgcaaaattgaagaacgtagtgggacaccatgaggccgcaaccaatatagtaaaggattacagatacacttatgataagtatttcctccatatgccgatcacgattaatttcaaggcgaataaaaccggcttcattaacgatcgcattttgcaatatattgcgaaggaaaaggatttgcacgtgataggtatagaccggggtgaacgaaacttgatttacgtctctgtgatcgacacatgcggaaatatagttgaacagaagtcctttaatattgtgaatggttacgactaccagataaaattgaagcaacaggagggcgcaagacagatagctcgcaaagagtggaaggaaatcggcaagatcaaagaaataaaggagggttatctttccctggtaattcatgaaattagcaagatggttattaagtataatgctataatagctatggaggacctttcctatgggttcaagaaaggtcgcttcaaagtggagcgacaagtgtatcaaaagttcgagactatgttgataaataaattgaattatttggtttttaaagacatttcaataactgagaacgggggtctcttgaaggggtaccaattgacttatattccggacaagttgaagaatgtcggacaccagtgtggttgcattttctacgtgcctgccgcttacacctcaaaaatcgatccgaccactggttttgtaaatatatttaaattcaaagatctcaccgttgatgccaaacgggagtttatcaaaaaattcgattccattcgctacgactctgagaaaaaccttttttgtttcacgttcgattataacaactttataacccaaaatactgtaatgtccaagtcaagttggtctgtctatacttacggagtaaggatcaagcgccgcttcgttaatgggagattctcaaacgagtctgataccatagacataactaaagacatggaaaaaaccctggaaatgacggacatcaattggcgagacgggcatgatcttcgacaggacataatagattacgaaattgttcaacacattttcgagatatttcgacttacggttcagatgaggaattccctttccgaattggaagaccgggattatgatcgacttatatctcccgtgctcaatgaaaacaatattttttatgattcagcgaaagctggggacgcgctgccaaaagatgccgatgccaatggagcatactgtatcgccctgaagggtttgtatgagattaagcaaattactgaaaactggaaggaagatggcaagttttctagagataagcttaagattagcaataaggactggtttgacttcattcaaaataaaaggtatcttaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 105 - DNA, 3960 bp, Artificial Sequence
  Description of Artificial Sequence: Synthetic polynucleotide
ccagcggctaaaaaaaagaaactggatggcagcgtggatatgaataatggaacaaataattttcaaaattttattggtatcagttcattgcaaaagactttgagaaatgctttgatcccgactgagaccacacagcagttcatcgtcaaaaatggcataatcaaggaagacgaacttaggggtgagaatagacaaatattgaaggacatcatggatgactattatagggggttcatttccgaaacgctcagtagtattgatgacattgactggactagtcttttcgagaaaatggaaattcagcttaagaacggggacaataaagacacgctgatcaaggagcaaacggaatataggaaggcgatccataaaaaattcgcgaatgatgatcggtttaaaaacatgtttagtgccaagttgatcagcgacatactgcccgaattcgtgatccacaacaataattacagcgcctccgaaaaggaggaaaaaactcaggtcattaaattgtttagccgattcgcaacgagtttcaaagattattttaagaaccgggccaactgtttttcagcggatgatattagctccagcagctgccatcgcatagtaaatgataacgctgaaatcttttttagcaacgcacttgtctaccggaggattgtaaaatcactgtcaaatgatgacattaacaaaatatctggagatatgaaggactcactcaaagaaatgagcctggaagaaatatattcatacgaaaaatacggggagtttattacccaggaaggtatcagtttttataatgatatatgtggaaaagttaattcatttatgaatctttactgtcaaaaaaataaggagaacaagaatttgtacaagctccaaaaacttcataaacagattctgtgcatcgcagacacaagttatgaggtaccgtacaaatttgagagcgacgaagaagtttatcagagtgtgaatggtttcctggacaatatctcttctaaacacattgttgagaggcttaggaagatcggtgataattataacggctataatctggacaaaatttatattgtatcaaagttttatgaatcagtctctcaaaagacgtatcgggattgggaaacaattaacacggctctggagatccactacaataacattctgcccggcaacgggaagagcaaagctgataaggtcaagaaggcagtcaagaacgaccttcagaagagcataacagaaattaacgaattggtcagtaactacaaactgtgtagtgatgacaacataaaagccgaaacatacatccatgaaataagccatatcctgaataacttcgaagcccaagaacttaaatacaatcccgagattcatcttgtcgaatcagaactcaaggcgtccgagctcaaaaatgtccttgacgtgataatgaatgccttccactggtgcagcgtattcatgacggaggagttggtagataaagacaacaacttttatgccgaattggaagagatttatgatgagatttaccccgttatttctctgtacaacttggttcgaaactacgtaacacaaaaaccatactcaaccaaaaagatcaaactcaattttggcatacctacattggctgatggttggtccaagtcaaaggaatatagcaataatgcaataattctcatgcgagataacttgtattatttggggatctttaacgctaagaacaaaccagataaaaagataatcgaggggaacacaagtgagaacaagggtgattacaaaaaaatgatttacaatctgcttcctgggcctaacaaaatgattccgaaggtgtttcttagctctaaaactggagtggagacgtataagccttccgcgtacattctcgaaggctacaagcaaaataagcatatcaagtccagtaaggacttcgacatcactttttgccacgatctcatcgattactttaagaactgtatcgcaatacaccccgagtggaaaaactttggttttgatttttcagacactagtacctacgaggacatttccggcttctatcgagaagtcgaactccagggctacaaaatcgattggacgtacatttctgagaaggacatcgacttgctccaagagaaaggtcaactttacctcttccaaatttacaataaagacttttcaaagaagagcaccggtaatgacaacttgcataccatgtatctgaagaacctgttttctgaggagaacctcaaggatattgtattgaagttgaatggcgaagcagaaatatttttccgaaagtcatctatcaagaaccccattatacacaaaaaaggctctatcctggtgaaccggacttacgaggcagaggagaaggatcaattcggaaacatacagatagtccgcaaaaacatccctgagaatatctatcaggaactctataagtacttcaatgataaatcagacaaggagcttagcgacgaagcagctaaacttaaaaacgtggttggccatcacgaggccgctaccaacatagtcaaagactaccgctatacttatgacaagtactttttgcacatgcccataacaattaatttcaaagctaacaaaacagggtttataaatgacagaatcctccaatacatcgccaaagagaaggacctccatgtaatcgggattgatagaggcgaacggaacttgatttacgttagtgtcattgatacctgtggtaacattgtcgaacaaaagtcattcaacatagtcaatggatatgattatcagataaaactcaagcaacaagaaggcgcgaggcagattgccaggaaggaatggaaagaaatcgggaagatcaaggagatcaaggagggttacctgtccttggtgatacacgagatttcaaaaatggttataaaatacaatgccattatcgcgatggaggatttgtcttatggatttaagaaggggaggttcaaagtcgaacgacaagtctatcagaagtttgaaacaatgctcattaacaagctcaattaccttgttttcaaggatataagcatcactgaaaacggcggactccttaagggatatcagctgacttatatccccgacaagctcaagaacgtagggcaccaatgcggatgcatcttttacgtgcctgcagcatatacttcaaaaattgatccgactactggctttgttaacattttcaagttcaaggatctgacggtagacgctaagagagaattcataaaaaagtttgacagcatcaggtacgatagtgaaaagaaccttttttgttttacctttgactacaataattttattacgcaaaatacagttatgagcaaatcaagttggagcgtttacacatatggcgttcggatcaagcgcagattcgtcaatggtcgcttctcaaatgagagcgatacaatcgatataacgaaggatatggagaagacgcttgagatgacagatatcaactggcgggacggacatgaccttagacaagacataatcgattacgaaatagtacagcatatctttgagatttttaggcttacagttcagatgcggaactctctttccgaactggaggaccgggattatgatcggttgatctccccagtactgaacgaaaataatatcttttacgatagcgcgaaggctggtgatgcactcccaaaagacgctgatgcgaacggagcttattgcatagcccttaaagggctttacgagattaaacaaataacagaaaattggaaggaagatggcaaattttcccgcgacaagttgaagattagtaacaaagactggttcgacttcattcagaataaacgctacctcaaacgtccggcagcgaccaaaaaagccggccaggcgaagaaaaaaaaagcgtcaggtagcggcgcaggcagcccgaaaaagaaacgtaaagtcgaggatccgaaaaagaaacgtaaggttattccgggctaa

SEQ ID NO: 106 - skipped

SEQ ID NO: 107 - protein, 25 aa, Artificial Sequence
  Description of Artificial Sequence: Synthetic peptide
MSRRRKANPTKLSENAKKLAKEVEN

SEQ ID NO: 108 - protein, 7 aa, Artificial Sequence
  Description of Artificial Sequence: Synthetic peptide
ENLYFQS

SEQ ID NO: 109 - protein, 1374 aa, Artificial Sequence
  Description of Artificial Sequence: Synthetic polypeptide
SMSRRRKANPTKLSENAKKLAKEVENASGSGAGSKRPAATKKAGQAKKKKASGSGAGSPAAKKKKLDGSVDASGSGAGSPKKKRKVEDASGSGAGSPKKKRKVASGSGAGSMNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQTEYRKAIHKKFANDDRFKNMFSAKLISDILPEFVIHNNNYSASEKEEKTQVIKLFSRFATSFKDYFKNRANCFSADDISSSSCHRIVNDNAEIFFSNALVYRRIVKSLSNDDINKISGDMKDSLKEMSLEEIYSYEKYGEFITQEGISFYNDICGKVNSFMNLYCQKNKENKNLYKLQKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCSDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHIKSSKDFDITFCHDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKNIPENIYQELYKYFNDKSDKELSDEAAKLKNVVGHHEAATNIVKDYRYTYDKYFLHMPITINFKANKTGFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFRLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 110 - protein, 1373 aa, Artificial Sequence
  Description of Artificial Sequence: Synthetic polypeptide
MSRRRKANPTKLSENAKKLAKEVENASGSGAGSKRPAATKKAGQAKKKKASGSGAGSPAAKKKKLDGSVDASGSGAGSPKKKRKVEDASGSGAGSPKKKRKVASGSGAGSMNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQTEYRKAIHKKFANDDRFKNMFSAKLISDILPEFVIHNNNYSASEKEEKTQVIKLFSRFATSFKDYFKNRANCFSADDISSSSCHRIVNDNAEIFFSNALVYRRIVKSLSNDDINKISGDMKDSLKEMSLEEIYSYEKYGEFITQEGISFYNDICGKVNSFMNLYCQKNKENKNLYKLQKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCSDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHIKSSKDFDITFCHDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKNIPENIYQELYKYFNDKSDKELSDEAAKLKNVVGHHEAATNIVKDYRYTYDKYFLHMPITINFKANKTGFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFRLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 111 - protein, 1395 aa, Artificial Sequence
  Description of Artificial Sequence: Synthetic polypeptide
GHHHHHHSSGVDLGTENLYFQSMSRRRKANPTKLSENAKKLAKEVENASGSGAGSKRPAATKKAGQAKKKKASGSGAGSPAAKKKKLDGSVDASGSGAGSPKKKRKVEDASGSGAGSPKKKRKVASGSGAGSMNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQTEYRKAIHKKFANDDRFKNMFSAKLISDILPEFVIHNNNYSASEKEEKTQVIKLFSRFATSFKDYFKNRANCFSADDISSSSCHRIVNDNAEIFFSNALVYRRIVKSLSNDDINKISGDMKDSLKEMSLEEIYSYEKYGEFITQEGISFYNDICGKVNSFMNLYCQKNKENKNLYKLQKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCSDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHIKSSKDFDITFCHDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKNIPENIYQELYKYFNDKSDKELSDEAAKLKNVVGHHEAATNIVKDYRYTYDKYFLHMPITINFKANKTGFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFRLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 112 - protein, 1396 aa, Artificial Sequence
  Description of Artificial Sequence: Synthetic polypeptide
MGHHHHHHSSGVDLGTENLYFQSMSRRRKANPTKLSENAKKLAKEVENASGSGAGSKRPAATKKAGQAKKKKASGSGAGSPAAKKKKLDGSVDASGSGAGSPKKKRKVEDASGSGAGSPKKKRKVASGSGAGSMNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQTEYRKAIHKKFANDDRFKNMFSAKLISDILPEFVIHNNNYSASEKEEKTQVIKLFSRFATSFKDYFKNRANCFSADDISSSSCHRIVNDNAEIFFSNALVYRRIVKSLSNDDINKISGDMKDSLKEMSLEEIYSYEKYGEFITQEGISFYNDICGKVNSFMNLYCQKNKENKNLYKLQKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCSDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHIKSSKDFDITFCHDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKNIPENIYQELYKYFNDKSDKELSDEAAKLKNVVGHHEAATNIVKDYRYTYDKYFLHMPITINFKANKTGFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFRLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 113 - DNA, 4190 bp, Artificial Sequence
  Description of Artificial Sequence: Synthetic polynucleotide
atgggccatcatcatcatcatcatagcagcggcgtggatctgggcaccgaaaacctgtattttcagtccatgagccgccgccgcaaagcgaacccgaccaaactgagcgaaaacgcgaaaaaactggcgaaagaagtggaaaacgcaagcggcagcggcgcgggcagcaaacgaccggcggcgaccaaaaaagcgggccaagcgaagaaaaagaaagcaagcggcagcggcgcgggcagcccggcggcaaaaaaaaaaaaactggacggcagcgtggatgcaagcggcagcggcgcgggcagccccaaaaaaaaacgcaaagttgaagatgcaagcggcagcggcgcgggcagcccgaaaaaaaaacgtaaagtggcaagcggcagcggcgcgggcagcatgaacaacggcaccaacaactttcagaactttattggcattagcagcctgcagaaaaccctgcgcaacgcgctgattccgaccgaaaccacgcagcagtttattgtgaaaaacggcattattaaagaagatgaactgcgcggcgaaaaccgtcagattctgaaggacattatggatgattattatcgcggctttattagcgaaaccctgagcagcattgatgatatagactggacgagcctgtttgaaaaaatggaaattcagctgaaaaacggcgataacaaagataccctgattaaagaacagaccgaatatcgcaaagcgattcataagaagtttgcgaacgatgatcgctttaaaaacatgtttagcgcgaaactgattagcgatattctgccggaatttgtgattcataacaacaactatagcgcgagcgaaaaggaagaaaaaacccaagtgattaaactgtttagccgctttgcgacgagctttaaagattattttaaaaatcgcgcgaactgctttagcgcggatgatattagcagcagcagctgccatcgcattgtgaacgataacgcggagatcttttttagcaatgcgctggtgtatcgccgcattgtgaaaagcctgagcaacgatgatattaacaaaattagcggcgatatgaaagatagcctgaaagaaatgagcctggaagaaatatatagctatgaaaaatatggggaatttattacacaagagggcattagcttttataacgatatttgcggcaaagtgaacagctttatgaacctgtattgtcagaaaaacaaagaaaacaaaaacctgtataaactgcagaaactgcataaacagattctgtgcattgcggatacgagctatgaagtgccgtataaatttgaaagcgatgaagaagtgtatcagagcgtgaacggctttctggataacattagcagcaaacatattgtggaacgcctgcgcaaaattggcgataactataacggctataacctggataaaatttatattgtgagcaaattttatgaaagcgtgagtcagaaaacctatcgcgattgggaaaccattaacaccgcgctggaaattcattataacaacattctgccgggcaacggcaaaagtaaagcggataaagtgaaaaaagcggtgaaaaacgatctgcagaaaagcattacggaaattaacgaactggtgagcaactataaactgtgcagcgatgataacattaaagcggaaacctatattcacgagatcagtcatattctgaacaactttgaagcgcaagaactgaaatataacccggaaattcatctggtggaatcagaactgaaggcgagcgaacttaagaatgtgctagatgtgattatgaacgcgtttcattggtgcagcgtgtttatgaccgaagaactggtggataaagataacaacttttatgcggaactggaagaaatctacgacgaaatttatccggtgattagcctgtataacctggtgcgcaactatgtgacgcagaaaccgtatagcaccaaaaaaattaaactgaactttggcattccgaccctggcggatggctggagcaagagcaaagagtatagcaacaacgctattatcctaatgcgcgataacctgtattatctgggcatttttaacgcgaaaaacaaaccggataaaaaaattattgaaggcaacacgagcgaaaacaaaggcgattataaaaaaatgatttataacctgctgccgggcccgaacaaaatgattccgaaagtgtttctgagcagcaaaaccggcgtggaaacctataaaccgagcgcgtatattctggaaggctataaacagaacaaacatattaaaagcagcaaagattttgatattaccttttgccatgatctgattgactactttaagaactgtatagcgattcatccggaatggaaaaactttggctttgattttagcgatacgagcacctatgaagacattagcggcttttatcgcgaagtggaactgcaaggctataaaattgattggacctatattagcgaaaaagatattgatctgctgcaagaaaaaggtcagctgtatctgtttcagatttataacaaagattttagcaaaaaaagcaccggcaacgataacctgcataccatgtatctgaaaaatctgttttctgaagaaaacctaaaagatattgtcctgaaactgaacggcgaagccgaaattttttttcgcaagagcagcattaaaaacccgattattcacaaaaaaggtagcattctggtgaaccgcacatacgaagctgaggaaaaggatcagtttggcaacattcagattgtgcgcaaaaacattccggaaaacatctaccaagaactgtacaaatattttaacgataaaagcgataaagaactgagcgacgaggctgcgaagctgaagaatgtcgtgggccatcatgaagcggcgactaacattgtcaaagattatcgctatacctatgataaatattttctgcatatgccgattaccattaactttaaagcgaacaaaaccggctttattaacgatcgcattctgcagtatattgcgaaggaaaaggatctgcacgtgattggcattgatcgcggcgaacgcaacctgatttatgtgagcgtgattgatacctgcggcaacattgtggaacagaaaagctttaacatcgtgaacggctatgattatcagattaaactgaaacagcaagaaggcgcgcgtcagattgcgcgcaaagaatggaaagaaattggcaaaattaaagaaattaaagaaggctatctgagcctggtgattcatgaaatcagcaagatggtgattaaatataatgccattattgcgatggaagatctgagctatggctttaaaaaaggccgctttaaagtggaacgccaagtgtatcagaaatttgaaaccatgctgattaacaaactgaactatctggtgtttaaagatattagtattactgaaaatggcggcctgctgaaaggctatcagctgacctatattccggacaagctgaagaatgtgggccatcagtgcggctgcattttttatgtgccggcggcgtatacgagcaaaattgatccgaccaccggctttgtgaacatttttaaatttaaagatctgaccgtggatgcgaaacgggaattcataaaaaaatttgatagcattcgctatgatagcgaaaagaatctgttttgcttcacctttgattataacaactttataacgcagaacaccgtgatgagcaaaagcagctggagcgtgtatacctatggcgtgcgcattaaacgccgctttgtgaacggccgctttagcaacgaaagcgataccattgatattaccaaagatatggaaaaaaccctggaaatgaccgatattaactggcgcgatggccatgatctgcgccaagatattattgattatgaaattgtgcagcatatttttgaaatttttcgcctgaccgtgcagatgcgcaacagcctgagcgaactggaagatcgcgattatgatcgcctgattagcccggtgctgaacgaaaacaacattttttatgatagcgcgaaagcgggcgatgcgctgccgaaagatgcggatgcgaacggcgcgtattgcattgcgctgaaaggcctgtatgaaattaaacagattacggaaaactggaaagaagatggcaaatttagccgcgacaagctgaaaattagcaacaaagattggtttgattttattcagaacaaacgctatctgta

SEQ ID NO: 114 - RNA, 21 nt, Artificial Sequence
  Description of Artificial Sequence: Synthetic oligonucleotide
accgcggccauccugcaggca

SEQ ID NO: 115 - RNA, 21 nt, Artificial Sequence
  Description of Artificial Sequence: Synthetic oligonucleotide
ugagggaaaggacaagaugaa

SEQ ID NO: 116 - RNA, 21 nt, Artificial Sequence
  Description of Artificial Sequence: Synthetic oligonucleotide
ggauccagcaggccaaagcuc

SEQ ID NO: 117 - RNA, 21 nt, Artificial Sequence
  Description of Artificial Sequence: Synthetic oligonucleotide
cuagcagagaaggaagaaccc

SEQ ID NO: 118 - RNA, 21 nt, Artificial Sequence
  Description of Artificial Sequence: Synthetic oligonucleotide
uguguugcaguucagcaggag

SEQ ID NO: 119 - RNA, 21 nt, Artificial Sequence
  Description of Artificial Sequence: Synthetic oligonucleotide
cugaggguucuuccuucucug

SEQ ID NO: 120 - RNA, 21 nt, Artificial Sequence
  Description of Artificial Sequence: Synthetic oligonucleotide
ccguugucuuuccuagcagag

SEQ ID NO: 121 - RNA, 21 nt, Artificial Sequence
  Description of Artificial Sequence: Synthetic oligonucleotide
ugcaguuccugcagaagaggg

SEQ ID NO: 122 - RNA, 21 nt, Artificial Sequence
  Description of Artificial Sequence: Synthetic oligonucleotide
ugcaggaacugcagaaagaua

SEQ ID NO: 123 - RNA, 21 nt, Artificial Sequence
  Description of Artificial Sequence: Synthetic oligonucleotide
aucccaaucucacuguaggcc

SEQ ID NO: 124 - RNA, 21 nt, Artificial Sequence
  Description of Artificial Sequence: Synthetic oligonucleotide
caucccaaucucacuguaggc

SEQ ID NO: 125 - RNA, 21 nt, Artificial Sequence
  Description of Artificial Sequence: Synthetic oligonucleotide
cucauuucacucccaaacaac

SEQ ID NO: 126 - RNA, 21 nt, Artificial Sequence
  Description of Artificial Sequence: Synthetic oligonucleotide
ucauuucacucccaaacaacc

SEQ ID NO: 127 - RNA, 21 nt, Artificial Sequence
  Description of Artificial Sequence: Synthetic oligonucleotide
acucccaaacaaccagcgccg

SEQ ID NO: 128 - RNA, 21 nt, Artificial Sequence
  Description of Artificial Sequence: Synthetic oligonucleotide
cguuauagagcugguucuggc

SEQ ID NO: 129 - RNA, 21 nt, Artificial Sequence
  Description of Artificial Sequence: Synthetic oligonucleotide
uuuucugauuugcuuucacgc

SEQ ID NO: 130 - RNA, 21 nt, Artificial Sequence
  Description of Artificial Sequence: Synthetic oligonucleotide
ugauuugcuuucacgccaggg

SEQ ID NO: 131 - RNA, 21 nt, Artificial Sequence
  Description of Artificial Sequence: Synthetic oligonucleotide
cuuucacgccagggucucagu

SEQ ID NO: 132 - RNA, 21 nt, Artificial Sequence
  Description of Artificial Sequence: Synthetic oligonucleotide
acgccagggucucaguacagc

SEQ ID NO: 133 - RNA, 21 nt, Artificial Sequence
  Description of Artificial Sequence: Synthetic oligonucleotide
cggagggucuacggcgaggcu

SEQ ID NO: 134 - RNA, 21 nt, Artificial Sequence
  Description of Artificial Sequence: Synthetic oligonucleotide
uuaucuguuauaggagcucaa

SEQ ID NO: 135 - RNA, 21 nt, Artificial Sequence
  Description of Artificial Sequence: Synthetic oligonucleotide
ucuguuauaggagcucaaucu

SEQ ID NO: 136 - RNA, 21 nt, Artificial Sequence
  Description of Artificial Sequence: Synthetic oligonucleotide
uccaaaacaucguacuccucu

SEQ ID NO: 137 - RNA, 21 nt, Artificial Sequence
  Description of Artificial Sequence: Synthetic oligonucleotide
cccccaucucagggucccggc

SEQ ID NO: 138 - RNA, 21 nt, Artificial Sequence
  Description of Artificial Sequence: Synthetic oligonucleotide
gacaagagacguggccgggac

SEQ ID NO: 139 - RNA, 21 nt, Artificial Sequence
  Description of Artificial Sequence: Synthetic oligonucleotide
ucucccucuaacgucuucccg

SEQ ID NO: 140 - RNA, 21 nt, Artificial Sequence
  Description of Artificial Sequence: Synthetic oligonucleotide
ccuggagaugcauacucacac

SEQ ID NO: 141 - RNA, 21 nt, Artificial Sequence
  Description of Artificial Sequence: Synthetic oligonucleotide
cagaagacagggaugaagaga

SEQ ID NO: 142 - RNA, 21 nt, Artificial Sequence
  Description of Artificial Sequence: Synthetic oligonucleotide
cacuggaggugcccgugcaga

SEQ ID NO: 143 - RNA, 21 nt, Artificial Sequence
  Description of Artificial Sequence: Synthetic oligonucleotide
ugugugaguaugcaucuccag

SEQ ID NO: 144 - RNA, 21 nt, Artificial Sequence
  Description of Artificial Sequence: Synthetic oligonucleotide
agcggcacaaggcucagcuga

SEQ ID NO: 145 - RNA, 21 nt, Artificial Sequence
  Description of Artificial Sequence: Synthetic oligonucleotide
ugccgcugaaauccaaggcaa

SEQ ID NO: 146 - RNA, 21 nt, Artificial Sequence
  Description of Artificial Sequence: Synthetic oligonucleotide
uccaugcuagcaaugcacgug

SEQ ID NO: 147 - RNA, 21 nt, Artificial Sequence
  Description of Artificial Sequence: Synthetic oligonucleotide
ccaugcuagcaaugcacgugg

SEQ ID NO: 148 - RNA, 21 nt, Artificial Sequence
  Description of Artificial Sequence: Synthetic oligonucleotide
gugugugaguaugcaucucca

SEQ ID NO: 149 - RNA, 21 nt, Artificial Sequence
  Description of Artificial Sequence: Synthetic oligonucleotide
gccuggagaugcauacucaca

SEQ ID NO: 150 - RNA, 21 nt, Artificial Sequence
  Description of Artificial Sequence: Synthetic oligonucleotide
ggcaggcugacagccagguga

SEQ ID NO: 151 - RNA, 21 nt, Artificial Sequence
  Description of Artificial Sequence: Synthetic oligonucleotide
agucaccuggcugucagccug

SEQ ID NO: 152 - RNA, 21 nt, Artificial Sequence
  Description of Artificial Sequence: Synthetic oligonucleotide
cuagaugauuccaucugcacg

SEQ ID NO: 153 - RNA, 21 nt, Artificial Sequence
  Description of Artificial Sequence: Synthetic oligonucleotide
ccuuggauuucagcggcacaa

SEQ ID NO: 154 - RNA, 21 nt, Artificial Sequence
  Description of Artificial Sequence: Synthetic oligonucleotide
auuuccacuggaggugcccgu

SEQ ID NO: 155 - RNA, 21 nt, Artificial Sequence
  Description of Artificial Sequence: Synthetic oligonucleotide
gauagugagguucacuugauu

SEQ ID NO: 156 - RNA, 21 nt, Artificial Sequence
  Description of Artificial Sequence: Synthetic oligonucleotide
cagauguagagucccgugucc

SEQ ID NO: 157 - RNA, 21 nt, Artificial Sequence
  Description of Artificial Sequence: Synthetic oligonucleotide
cucaccaauuacauaaaucug

SEQ ID NO: 158 - RNA, 21 nt, Artificial Sequence
  Description of Artificial Sequence: Synthetic oligonucleotide
gcucaccaauuacauaaaucu

SEQ ID NO: 159 - RNA, 21 nt, Artificial Sequence
  Description of Artificial Sequence: Synthetic oligonucleotide
guuuucuguugcagauccaga

SEQ ID NO: 160 - RNA, 21 nt, Artificial Sequence
  Description of Artificial Sequence: Synthetic oligonucleotide
uuuucuguugcagauccagaa

SEQ ID NO: 161 - RNA, 21 nt, Artificial Sequence
  Description of Artificial Sequence: Synthetic oligonucleotide
cuguugcagauccagaaccgu

SEQ ID NO: 162 - RNA, 21 nt, Artificial Sequence
  Description of Artificial Sequence: Synthetic oligonucleotide
cuccucuggauccuugcagca

SEQ ID NO: 163 - RNA, 21 nt, Artificial Sequence
  Description of Artificial Sequence: Synthetic oligonucleotide
cagcaguuaguucgggguugu

SEQ ID NO: 164 - RNA, 21 nt, Artificial Sequence
  Description of Artificial Sequence: Synthetic oligonucleotide
gauuucagcggcacaaggcuc

SEQ ID NO: 165 - RNA, 21 nt, Artificial Sequence
  Description of Artificial Sequence: Synthetic oligonucleotide
uuuauagcuuucuccucacag

SEQ ID NO: 166 - RNA, 21 nt, Artificial Sequence
  Description of Artificial Sequence: Synthetic oligonucleotide
cuccucacagcuguuucuuug

SEQ ID NO: 167 - RNA, 21 nt, Artificial Sequence
  Description of Artificial Sequence: Synthetic oligonucleotide
uccucacagcuguuucuuuga

SEQ ID NO: 168 - RNA, 21 nt, Artificial Sequence
  Description of Artificial Sequence: Synthetic oligonucleotide
gcucaaagaaacagcugugag

SEQ ID NO: 169 - RNA, 21 nt, Artificial Sequence
  Description of Artificial Sequence: Synthetic oligonucleotide
uuuuuguguuugacagcuaaa

SEQ ID NO: 170 - RNA, 21 nt, Artificial Sequence
  Description of Artificial Sequence: Synthetic oligonucleotide
uguguuugacagcuaaagaaa

SEQ ID NO: 171 - RNA, 21 nt, Artificial Sequence
  Description of Artificial Sequence: Synthetic oligonucleotide
acagcuaaagaaaagaagccc

SEQ ID NO: 172 - RNA, 21 nt, Artificial Sequence
  Description of Artificial Sequence: Synthetic oligonucleotide
cacauagaccccuguuguaag

SEQ ID NO: 173 - RNA, 21 nt, Artificial Sequence
  Description of Artificial Sequence: Synthetic oligonucleotide
cacauucuggcucuguugggg

SEQ ID NO: 174 - RNA, 21 nt, Artificial Sequence
  Description of Artificial Sequence: Synthetic oligonucleotide
ucacauucuggcucuguuggg

SEQ ID NO: 175 - RNA, 21 nt, Artificial Sequence
  Description of Artificial Sequence: Synthetic oligonucleotide
agccuuauuuuauucccauca

SEQ ID NO: 176 - RNA, 21 nt, Artificial Sequence
  Description of Artificial Sequence: Synthetic oligonucleotide
ucaauugaugggaauaaaaua

SEQ ID NO: 177 - RNA, 21 nt, Artificial Sequence
  Description of Artificial Sequence: Synthetic oligonucleotide
uucuucucuucaucccugucu

SEQ ID NO: 178 - RNA, 21 nt, Artificial Sequence
  Description of Artificial Sequence: Synthetic oligonucleotide
gcagaagacagggaugaagag

SEQ ID NO: 179 - RNA, 21 nt, Artificial Sequence
  Description of Artificial Sequence: Synthetic oligonucleotide
ggcuuuuccaugcuagcaaug

SEQ ID NO: 180 - RNA, 21 nt, Artificial Sequence
  Description of Artificial Sequence: Synthetic oligonucleotide
gcuuuuccaugcuagcaaugc

SEQ ID NO: 181 - RNA, 21 nt, Artificial Sequence
  Description of Artificial Sequence: Synthetic oligonucleotide
gggugcauaccugucuggcug

SEQ ID NO: 182 - RNA, 21 nt, Artificial Sequence
  Description of Artificial Sequence: Synthetic oligonucleotide
ggucaccuggaucccugggga

SEQ ID NO: 183 - RNA, 21 nt, Artificial Sequence
  Description of Artificial Sequence: Synthetic oligonucleotide
ucaggaccuuggcuggaggca

SEQ ID NO: 184 - RNA, 21 nt, Artificial Sequence
  Description of Artificial Sequence: Synthetic oligonucleotide
ccagccuuggcaaugccagcu

SEQ ID NO: 185 - RNA, 21 nt, Artificial Sequence
  Description of Artificial Sequence: Synthetic oligonucleotide
ugaggugacuccaguaucugg

SEQ ID NO: 186 - RNA, 21 nt, Artificial Sequence
  Description of Artificial Sequence: Synthetic oligonucleotide
cuguuucugcagccgcuuugg

SEQ ID NO: 187 - RNA, 21 nt, Artificial Sequence
  Description of Artificial Sequence: Synthetic oligonucleotide
cacagugacugccagcccccc

SEQ ID NO: 188 - RNA, 21 nt, Artificial Sequence
  Description of Artificial Sequence: Synthetic oligonucleotide
gaacugcuccuucagccgccc

SEQ ID NO: 189 - RNA, 21 nt, Artificial Sequence
  Description of Artificial Sequence: Synthetic oligonucleotide
agccgcccugaccgcccagcc

SEQ ID NO: 190 - RNA, 21 nt, Artificial Sequence
  Description of Artificial Sequence: Synthetic oligonucleotide
cgcuaaguggugaugggggga

SEQ ID NO: 191 - RNA, 21 nt, Artificial Sequence
  Description of Artificial Sequence: Synthetic oligonucleotide
ccgcuaaguggugaugggggg

SEQ ID NO: 192 - RNA, 21 nt, Artificial Sequence
  Description of Artificial Sequence: Synthetic oligonucleotide
gcggaaagcuuccucuuccug

SEQ ID NO: 193 - RNA, 21 nt, Artificial Sequence
  Description of Artificial Sequence: Synthetic oligonucleotide
gggcaggaagaggaagcuuuc

SEQ ID NO: 194 - RNA, 21 nt, Artificial Sequence
  Description of Artificial Sequence: Synthetic oligonucleotide
cucuuccugccccaagucagc

SEQ ID NO: 195 - RNA, 21 nt, Artificial Sequence
  Description of Artificial Sequence: Synthetic oligonucleotide
aacgucuccaucauguauaac

SEQ ID NO: 196 - RNA, 21 nt, Artificial Sequence
  Description of Artificial Sequence: Synthetic oligonucleotide
cuuuucucuucaggucuggag

SEQ ID NO: 197 - RNA, 21 nt, Artificial Sequence
  Description of Artificial Sequence: Synthetic oligonucleotide
ugcagccgcuuuggguggcuc

SEQ ID NO: 198 - RNA, 21 nt, Artificial Sequence
  Description of Artificial Sequence: Synthetic oligonucleotide
cucuucaggucuggagccccc

SEQ ID NO: 199 - RNA, 21 nt, Artificial Sequence
  Description of Artificial Sequence: Synthetic oligonucleotide
acaguguacgcuggagcaggu

SEQ ID NO: 200 - RNA, 21 nt, Artificial Sequence
  Description of Artificial Sequence: Synthetic oligonucleotide
gcagugaggaaagaccggguc

SEQ ID NO: 201 - RNA, 21 nt, Artificial Sequence
  Description of Artificial Sequence: Synthetic oligonucleotide
cucacugccaaguggacuccu

SEQ ID NO: 202 - RNA, 21 nt, Artificial Sequence
  Description of Artificial Sequence: Synthetic oligonucleotide
acccuucgacuagaggaugug

SEQ ID NO: 203 - RNA, 21 nt, Artificial Sequence
  Description of Artificial Sequence: Synthetic oligonucleotide
cccuucgacuagaggauguga

SEQ ID NO: 204 - RNA, 21 nt, Artificial Sequence
  Description of Artificial Sequence: Synthetic oligonucleotide
gacuagaggaugugagccagg

SEQ ID NO: 205 - RNA, 21 nt, Artificial Sequence
  Description of Artificial Sequence: Synthetic oligonucleotide
ccaccugaggcugaccuguga

SEQ ID NO: 206 - RNA, 21 nt, Artificial Sequence
  Description of Artificial Sequence: Synthetic oligonucleotide
cccaccugaggcugaccugug

SEQ ID NO: 207 - RNA, 21 nt, Artificial Sequence
  Description of Artificial Sequence: Synthetic oligonucleotide
uacucuuuucagugacuccca

SEQ ID NO: 208 - RNA, 21 nt, Artificial Sequence
  Description of Artificial Sequence: Synthetic oligonucleotide
accuggagccacccaaagcgg

SEQ ID NO: 209 - RNA, 21 nt, Artificial Sequence
  Description of Artificial Sequence: Synthetic oligonucleotide
cagugacucccaaauccuuug

SEQ ID NO: 210 - RNA, 21 nt, Artificial Sequence
  Description of Artificial Sequence: Synthetic oligonucleotide
cccagggauccaggugaccca

SEQ ID NO: 211 - RNA, 21 nt, Artificial Sequence
  Description of Artificial Sequence: Synthetic oligonucleotide
gggucaccuggaucccugggg

SEQ ID NO: 212 - RNA, 21 nt, Artificial Sequence
  Description of Artificial Sequence: Synthetic oligonucleotide
gugaggugacuccaguaucug

SEQ ID NO: 213 - RNA, 21 nt, Artificial Sequence
  Description of Artificial Sequence: Synthetic oligonucleotide
guguggagcucucuggacacc

SEQ ID NO: 214 - RNA, 21 nt, Artificial Sequence
  Description of Artificial Sequence: Synthetic oligonucleotide
uguggagcucucuggacaccc

SEQ ID NO: 215 - RNA, 21 nt, Artificial Sequence
  Description of Artificial Sequence: Synthetic oligonucleotide
gcuggaggcacaggaggccca

SEQ ID NO: 216 - RNA, 21 nt, Artificial Sequence
  Description of Artificial Sequence: Synthetic oligonucleotide
gcucaccuagugaagccucuc

SEQ ID NO: 217 - RNA, 21 nt, Artificial Sequence
  Description of Artificial Sequence: Synthetic oligonucleotide
cccagccuuggcaaugccagc

SEQ ID NO: 218 - RNA, 21 nt, Artificial Sequence
  Description of Artificial Sequence: Synthetic oligonucleotide
gcaaugccagcuguaccaggg

SEQ ID NO: 219 - RNA, 21 nt, Artificial Sequence
  Description of Artificial Sequence: Synthetic oligonucleotide
uuggagcagcaguguacuuca

SEQ ID NO: 220 - RNA, 21 nt, Artificial Sequence
  Description of Artificial Sequence: Synthetic oligonucleotide
acagagcugucuagcccaggu

SEQ ID NO: 221 - RNA, 21 nt, Artificial Sequence
  Description of Artificial Sequence: Synthetic oligonucleotide
cuccauaggugcccaacgcuc

SEQ ID NO: 222 - RNA, 21 nt, Artificial Sequence
  Description of Artificial Sequence: Synthetic oligonucleotide
uccauaggugcccaacgcucu

SEQ ID NO: 223 - RNA, 21 nt, Artificial Sequence
  Description of Artificial Sequence: Synthetic oligonucleotide
ucauccuugguguccuuucuc

SEQ ID NO: 224 - RNA, 21 nt, Artificial Sequence
  Description of Artificial Sequence: Synthetic oligonucleotide
guguccuuucucugcuccuuu

SEQ ID NO: 225 - RNA, 21 nt, Artificial Sequence
  Description of Artificial Sequence: Synthetic oligonucleotide
cucugcuccuuuuggugacug

SEQ ID NO: 226 - RNA, 21 nt, Artificial Sequence
  Description of Artificial Sequence: Synthetic oligonucleotide
ugcgaagagcaggggucacuu

SEQ ID NO: 227 - RNA, 21 nt, Artificial Sequence
  Description of Artificial Sequence: Synthetic oligonucleotide
uggugacuggagccuuuggcu

SEQ ID NO: 228 - RNA, 21 nt, Artificial Sequence
  Description of Artificial Sequence: Synthetic oligonucleotide
ggugacuggagccuuuggcuu

SEQ ID NO: 229 - RNA, 21 nt, Artificial Sequence
  Description of Artificial Sequence: Synthetic oligonucleotide
ggcuuucaccuuuggagaaga

SEQ ID NO: 230 - RNA, 21 nt, Artificial Sequence
  Description of Artificial Sequence: Synthetic oligonucleotide
gcuuucaccuuuggagaagac

SEQ ID NO: 231 - RNA, 21 nt, Artificial Sequence
  Description of Artificial Sequence: Synthetic oligonucleotide
cucuaaggcagaaaaucgucu

SEQ ID NO: 232 - RNA, 21 nt, Artificial Sequence
  Description of Artificial Sequence: Synthetic oligonucleotide
cugccuuagagcaagggauuc

SEQ ID NO: 233 - RNA, 21 nt, Artificial Sequence
  Description of Artificial Sequence: Synthetic oligonucleotide
gagcaagggauucacccuccg

SEQ ID NO: 234 - RNA, 21 nt, Artificial Sequence
  Description of Artificial Sequence: Synthetic oligonucleotide
ccgcccaguggcccgcccgcu

SEQ ID NO: 235 - RNA, 21 nt, Artificial Sequence
  Description of Artificial Sequence: Synthetic oligonucleotide
ucgcuauggcugcgcccagcc

SEQ ID NO: 236 - RNA, 21 nt, Artificial Sequence
  Description of Artificial Sequence: Synthetic oligonucleotide
uccuugcacagugacugccag

SEQ ID NO: 237 - RNA, 21 nt, Artificial Sequence
  Description of Artificial Sequence: Synthetic oligonucleotide
gcacgaagcucuccgaugugu

SEQ ID NO: 238 - RNA, 21 nt, Artificial Sequence
  Description of Artificial Sequence: Synthetic oligonucleotide
ucugcagggacaauaggagcc

SEQ ID NO: 239 - RNA, 21 nt, Artificial Sequence
  Description of Artificial Sequence: Synthetic oligonucleotide
caguggcgagagaagaccccg

SEQ ID NO: 240 - RNA, 21 nt, Artificial Sequence
  Description of Artificial Sequence: Synthetic oligonucleotide
cuagcggaaugggcaccucau

SEQ ID NO: 241 - RNA, 21 nt, Artificial Sequence
  Description of Artificial Sequence: Synthetic oligonucleotide
gugcuaaacugguaccgcaug

SEQ ID NO: 242 - RNA, 21 nt, Artificial Sequence
  Description of Artificial Sequence: Synthetic oligonucleotide
aaccugaccugggacaguuuc

SEQ ID NO: 243 - RNA, 21 nt, Artificial Sequence
  Description of Artificial Sequence: Synthetic oligonucleotide
uccgucugguugcuggggcuc

SEQ ID NO: 244 - RNA, 21 nt, Artificial Sequence
  Description of Artificial Sequence: Synthetic oligonucleotide
cccgaggaccgcagccagccc

SEQ ID NO: 245 - RNA, 21 nt, Artificial Sequence
  Description of Artificial Sequence: Synthetic oligonucleotide
cgugucacacaacugcccaac

SEQ ID NO: 246 - RNA, 21 nt, Artificial Sequence
  Description of Artificial Sequence: Synthetic oligonucleotide
cacaugagcguggucagggcc

SEQ ID NO: 247 - RNA, 21 nt, Artificial Sequence
  Description of Artificial Sequence: Synthetic oligonucleotide
gaucugcgccuugggggccag

SEQ ID NO: 248 - RNA, 21 nt, Artificial Sequence
  Description of Artificial Sequence: Synthetic oligonucleotide
aucugcgccuugggggccagg

SEQ ID NO: 249 - RNA, 21 nt, Artificial Sequence
  Description of Artificial Sequence: Synthetic oligonucleotide
ggggccagggagauggcccca

SEQ ID NO: 250 - RNA, 21 nt, Artificial Sequence
  Description of Artificial Sequence: Synthetic oligonucleotide
gugcccuuccagagagaaggg

SEQ ID NO: 251 - RNA, 21 nt, Artificial Sequence
  Description of Artificial Sequence: Synthetic oligonucleotide
ugcccuuccagagagaagggc

SEQ ID NO: 252 - RNA, 21 nt, Artificial Sequence
  Description of Artificial Sequence: Synthetic oligonucleotide
ccuuccgcucaccuccgccug

SEQ ID NO: 253 - RNA, 21 nt, Artificial Sequence
  Description of Artificial Sequence: Synthetic oligonucleotide
cagagagaagggcagaagugc

SEQ ID NO: 254 - RNA, 21 nt, Artificial Sequence
  Description of Artificial Sequence: Synthetic oligonucleotide
ugcccuucucucuggaagggc

SEQ ID NO: 255 - RNA, 21 nt, Artificial Sequence
  Description of Artificial Sequence: Synthetic oligonucleotide
gaacuggccggcuggccuggg

SEQ ID NO: 256 - RNA, 21 nt, Artificial Sequence
  Description of Artificial Sequence: Synthetic oligonucleotide
cuccucaaagaaggaggaccc

SEQ ID NO: 257 - RNA, 21 nt, Artificial Sequence
  Description of Artificial Sequence: Synthetic oligonucleotide
uccucaaagaaggaggacccc

SEQ ID NO: 258 - RNA, 21 nt, Artificial Sequence
  Description of Artificial Sequence: Synthetic oligonucleotide
ucucgccacuggaaauccagc

SEQ ID NO: 259 - RNA, 21 nt, Artificial Sequence
  Description of Artificial Sequence: Synthetic oligonucleotide
ccuagcggaaugggcaccuca

SEQ ID NO: 260 - RNA, 21 nt, Artificial Sequence
  Description of Artificial Sequence: Synthetic oligonucleotide
cgcucaccuccgccugagcag

SEQ ID NO: 261 - RNA, 21 nt, Artificial Sequence
  Description of Artificial Sequence: Synthetic oligonucleotide
gccccucugaccggcuuccuu

SEQ ID NO: 262 - RNA, 21 nt, Artificial Sequence
  Description of Artificial Sequence: Synthetic oligonucleotide
uccacugcucaggcggaggug

SEQ ID NO: 263 - RNA, 21 nt, Artificial Sequence
  Description of Artificial Sequence: Synthetic oligonucleotide
uccccagcccugcucguggug

SEQ ID NO: 264 - RNA, 21 nt, Artificial Sequence
  Description of Artificial Sequence: Synthetic oligonucleotide
ggucaccacgagcagggcugg

SEQ ID NO: 265 - RNA, 21 nt, Artificial Sequence
  Description of Artificial Sequence: Synthetic oligonucleotide
accugcagcuucuccaacaca

SEQ ID NO: 266 - RNA, 21 nt, Artificial Sequence
  Description of Artificial Sequence: Synthetic oligonucleotide
uccaacacaucggagagcuuc

SEQ ID NO: 267 - RNA, 21 nt, Artificial Sequence
  Description of Artificial Sequence: Synthetic oligonucleotide
ccugacagcgaaucauaacau

SEQ ID NO: 268 - RNA, 21 nt, Artificial Sequence
  Description of Artificial Sequence: Synthetic oligonucleotide
auuccaacuuaccuaacggaa

SEQ ID NO: 269 - RNA, 21 nt, Artificial Sequence
  Description of Artificial Sequence: Synthetic oligonucleotide
ugugcgcacuggugaugacaa

SEQ ID NO: 270 - RNA, 21 nt, Artificial Sequence
  Description of Artificial Sequence: Synthetic oligonucleotide
caaucugcucaccugcuugag

SEQ ID NO: 271 - RNA, 21 nt, Artificial Sequence
  Description of Artificial Sequence: Synthetic oligonucleotide
uucuaguugaucauaccaggg

SEQ ID NO: 272 - RNA, 21 nt, Artificial Sequence
  Description of Artificial Sequence: Synthetic oligonucleotide
auaacuuaccucaaauucuuc

SEQ ID NO: 273 - RNA, 21 nt, Artificial Sequence
  Description of Artificial Sequence: Synthetic oligonucleotide
ccuaacggaaagugugaaguc

SEQ ID NO: 274 - RNA, 21 nt, Artificial Sequence
  Description of Artificial Sequence: Synthetic oligonucleotide
cagacacuacaacaacaggag

SEQ ID NO: 275 - RNA, 21 nt, Artificial Sequence
  Description of Artificial Sequence: Synthetic oligonucleotide
ggugguuucauggacaucucu

SEQ ID NO: 276 - RNA, 21 nt, Artificial Sequence
  Description of Artificial Sequence: Synthetic oligonucleotide
ccagagagauguccaugaaac

SEQ ID NO: 277 - RNA, 21 nt, Artificial Sequence
  Description of Artificial Sequence: Synthetic oligonucleotide
uaugaccuguauggaggggag

SEQ ID NO: 278 - RNA, 21 nt, Artificial Sequence
  Description of Artificial Sequence: Synthetic oligonucleotide
cgacucugacagagcuggugg

SEQ ID NO: 279 - RNA, 21 nt, Artificial Sequence
  Description of Artificial Sequence: Synthetic oligonucleotide
cagaagcaggaggugaagaac

SEQ ID NO: 280 - RNA, 21 nt, Artificial Sequence
  Description of Artificial Sequence: Synthetic oligonucleotide
acugccccccacccaggccug

SEQ ID NO: 281 - RNA, 21 nt, Artificial Sequence
  Description of Artificial Sequence: Synthetic oligonucleotide
ugggcccuacucugugaccaa

SEQ ID NO: 282 - RNA, 21 nt, Artificial Sequence
  Description of Artificial Sequence: Synthetic oligonucleotide
accgagaccucagugggcugg

SEQ ID NO: 283 - RNA, 21 nt, Artificial Sequence
  Description of Artificial Sequence: Synthetic oligonucleotide
ucuaggugguaccauggccac

SEQ ID NO: 284 - RNA, 21 nt, Artificial Sequence
  Description of Artificial Sequence: Synthetic oligonucleotide
gccugcagcagcgucucugcc

SEQ ID NO: 285 - RNA, 21 nt, Artificial Sequence
  Description of Artificial Sequence: Synthetic oligonucleotide
uugugcgugagagccucagcc

SEQ ID NO: 286 - RNA, 21 nt, Artificial Sequence
  Description of Artificial Sequence: Synthetic oligonucleotide
gugcuuucugugcucagugac

SEQ ID NO: 287 - RNA, 21 nt, Artificial Sequence
  Description of Artificial Sequence: Synthetic oligonucleotide
ggcuggucacugagcacagaa

SEQ ID NO: 288 - RNA, 21 nt, Artificial Sequence
  Description of Artificial Sequence: Synthetic oligonucleotide
cugugcucagugaccagccca

SEQ ID NO: 289 - RNA, 21 nt, Artificial Sequence
  Description of Artificial Sequence: Synthetic oligonucleotide
ugugcucagugaccagcccaa

SEQ ID NO: 290 - RNA, 21 nt, Artificial Sequence
  Description of Artificial Sequence: Synthetic oligonucleotide
augugggugacccugagcggg

SEQ ID NO: 291 - RNA, 21 nt, Artificial Sequence
  Description of Artificial Sequence: Synthetic oligonucleotide
ccucgcacaugaccuugaugu

SEQ ID NO: 292 - RNA, 21 nt, Artificial Sequence
  Description of Artificial Sequence: Synthetic oligonucleotide
gcuccccccaggguggacgcu

SEQ ID NO: 293 - RNA, 21 nt, Artificial Sequence
  Description of Artificial Sequence: Synthetic oligonucleotide
agcagggucucugcauccagc

SEQ ID NO: 294 - RNA, 21 nt, Artificial Sequence
  Description of Artificial Sequence: Synthetic oligonucleotide
gagaccuucgacagccucacg

SEQ ID NO: 295 - RNA, 21 nt, Artificial Sequence
  Description of Artificial Sequence: Synthetic oligonucleotide
gacagccucacggaccuggug

SEQ ID NO: 296 - RNA, 21 nt, Artificial Sequence
  Description of Artificial Sequence: Synthetic oligonucleotide
aagaagacggggauugaggag

SEQ ID NO: 297 - RNA, 21 nt, Artificial Sequence
  Description of Artificial Sequence: Synthetic oligonucleotide
uuguucaguuccaacacucgg

SEQ ID NO: 298 - RNA, 21 nt, Artificial Sequence
  Description of Artificial Sequence: Synthetic oligonucleotide
gcuguauccucggacuccugc

SEQ ID NO: 299 - RNA, 21 nt, Artificial Sequence
  Description of Artificial Sequence: Synthetic oligonucleotide
cccacccacaucucagaguuu

SEQ ID NO: 300 - RNA, 21 nt, Artificial Sequence
  Description of Artificial Sequence: Synthetic oligonucleotide
cagacgcuggugcaaguucuu

SEQ ID NO: 301 - RNA, 21 nt, Artificial Sequence
  Description of Artificial Sequence: Synthetic oligonucleotide
caccagcgucuggaagggcag

SEQ ID NO: 302 - RNA, 21 nt, Artificial Sequence
  Description of Artificial Sequence: Synthetic oligonucleotide
uucucuggccgcugcccuucc

SEQ ID NO: 303 - RNA, 21 nt, Artificial Sequence
  Description of Artificial Sequence: Synthetic oligonucleotide
auguaguuggcauugauguag

SEQ ID NO: 304 - RNA, 21 nt, Artificial Sequence
  Description of Artificial Sequence: Synthetic oligonucleotide
cguccagaaccagcugcuagg

SEQ ID NO: 305 - RNA, 21 nt, Artificial Sequence
  Description of Artificial Sequence: Synthetic oligonucleotide
uggcagauggcguggcaggag

SEQ ID NO: 306 - RNA, 21 nt, Artificial Sequence
  Description of Artificial Sequence: Synthetic oligonucleotide
uccaccucucggguggucaug

SEQ ID NO: 307 - RNA, 21 nt, Artificial Sequence
  Description of Artificial Sequence: Synthetic oligonucleotide
cuccaccucucggguggucau

SEQ ID NO: 308 - RNA, 21 nt, Artificial Sequence
  Description of Artificial Sequence: Synthetic oligonucleotide
ccagaacaaaugcgucccaua

SEQ ID NO: 309 - RNA, 21 nt, Artificial Sequence
  Description of Artificial Sequence: Synthetic oligonucleotide
cagaacaaaugcgucccauac

SEQ ID NO: 310 - RNA, 21 nt, Artificial Sequence
  Description of Artificial Sequence: Synthetic oligonucleotide
uauucgguugugucaugcucc

SEQ ID NO: 311 - RNA, 21 nt, Artificial Sequence
  Description of Artificial Sequence: Synthetic oligonucleotide
caggucuccccgcuggacaau

SEQ ID NO: 312 - RNA, 21 nt, Artificial Sequence
  Description of Artificial Sequence: Synthetic oligonucleotide
cuggcucggcccagucgcaag

SEQ ID NO: 313 - RNA, 21 nt, Artificial Sequence
  Description of Artificial Sequence: Synthetic oligonucleotide
gggagaccugauucgggagau

SEQ ID NO: 314 - RNA, 21 nt, Artificial Sequence
  Description of Artificial Sequence: Synthetic oligonucleotide
cuggaccagaucaaccagcgg

SEQ ID NO: 315 - RNA, 21 nt, Artificial Sequence
  Description of Artificial Sequence: Synthetic oligonucleotide
cugccgcugguugaucugguc

SEQ ID NO: 316 - RNA, 21 nt, Artificial Sequence
  Description of Artificial Sequence: Synthetic oligonucleotide
ccugccgcugguugaucuggu

SEQ ID NO: 317 - RNA, 21 nt, Artificial Sequence
  Description of Artificial Sequence: Synthetic oligonucleotide
guggagauguucuccaugagc

SEQ ID NO: 318 - RNA, 21 nt, Artificial Sequence
  Description of Artificial Sequence: Synthetic oligonucleotide
uacugcgccuccgucugcacc

SEQ ID NO: 319 - RNA, 21 nt, Artificial Sequence
  Description of Artificial Sequence: Synthetic oligonucleotide
aaugaacugggcgauggccac

SEQ ID NO: 320 - RNA, 21 nt, Artificial Sequence
  Description of Artificial Sequence: Synthetic oligonucleotide
uucuuagugguuucaaugaac

SEQ ID NO: 321 - RNA, 21 nt, Artificial Sequence
  Description of Artificial Sequence: Synthetic oligonucleotide
uccccuccauacaggucauag

SEQ ID NO: 322 - RNA, 21 nt, Artificial Sequence
  Description of Artificial Sequence: Synthetic oligonucleotide
gagucuagugcagggaccgug

SEQ ID NO: 323 - RNA, 21 nt, Artificial Sequence
  Description of Artificial Sequence: Synthetic oligonucleotide
ccccccugcacccggcugcag

SEQ ID NO: 324 - RNA, 21 nt, Artificial Sequence
  Description of Artificial Sequence: Synthetic oligonucleotide
ugucugcagccgggugcaggg

SEQ ID NO: 325 - RNA, 21 nt, Artificial Sequence
  Description of Artificial Sequence: Synthetic oligonucleotide
uccucccucuuguucuuagug

SEQ ID NO: 326 - RNA, 21 nt, Artificial Sequence
  Description of Artificial Sequence: Synthetic oligonucleotide
cuccucccucuuguucuuagu

SEQ ID NO: 327 - RNA, 21 nt, Artificial Sequence
  Description of Artificial Sequence: Synthetic oligonucleotide
uucacuuucuccucccucuug

SEQ ID NO: 328 - RNA, 21 nt, Artificial Sequence
  Description of Artificial Sequence: Synthetic oligonucleotide
agguggaugauggugccgucg

SEQ ID NO: 329 - RNA, 21 nt, Artificial Sequence
  Description of Artificial Sequence: Synthetic oligonucleotide
ccugacgcugccuucucuagg

SEQ ID NO: 330 - RNA, 21 nt, Artificial Sequence
  Description of Artificial Sequence: Synthetic oligonucleotide
aggccuuaccugaggcgaggg

SEQ ID NO: 331 - RNA, 21 nt, Artificial Sequence
  Description of Artificial Sequence: Synthetic oligonucleotide
guccucccucuaguggcugag

SEQ ID NO: 332 - RNA, 21 nt, Artificial Sequence
  Description of Artificial Sequence: Synthetic oligonucleotide
ggguggcacaucuccccaucc

SEQ ID NO: 333 - RNA, 21 nt, Artificial Sequence
  Description of Artificial Sequence: Synthetic oligonucleotide
ugcagagaaagguggcucuau

SEQ ID NO: 334 - RNA, 21 nt, Artificial Sequence
  Description of Artificial Sequence: Synthetic oligonucleotide
uaaugcugacuugggguggca

SEQ ID NO: 335 - RNA, 21 nt, Artificial Sequence
  Description of Artificial Sequence: Synthetic oligonucleotide
ccugaggcgaggggagccugc

SEQ ID NO: 336 - RNA, 21 nt, Artificial Sequence
  Description of Artificial Sequence: Synthetic oligonucleotide
aaggauggggagaugugccac

SEQ ID NO: 337 - RNA, 21 nt, Artificial Sequence
  Description of Artificial Sequence: Synthetic oligonucleotide
aaggaucgaguggccccaggu

SEQ ID NO: 338 - RNA, 21 nt, Artificial Sequence
  Description of Artificial Sequence: Synthetic oligonucleotide
ugcaucuaucacaccuacccu

SEQ ID NO: 339 - RNA, 21 nt, Artificial Sequence
  Description of Artificial Sequence: Synthetic oligonucleotide
uaggaccuccaggaagauucu

SEQ ID NO: 340 - RNA, 21 nt, Artificial Sequence
  Description of Artificial Sequence: Synthetic oligonucleotide
cuaggaccuccaggaagauuc

SEQ ID NO: 341 - RNA, 21 nt, Artificial Sequence
  Description of Artificial Sequence: Synthetic oligonucleotide
cuccagcaggaauaccugagc

SEQ ID NO: 342 - RNA, 21 nt, Artificial Sequence
  Description of Artificial Sequence: Synthetic oligonucleotide
gagccauggccgcgacgcugg

SEQ ID NO: 343 - RNA, 21 nt, Artificial Sequence
  Description of Artificial Sequence: Synthetic oligonucleotide
uagucaacgcgaccaccacga

SEQ ID NO: 344 - RNA, 21 nt, Artificial Sequence
  Description of Artificial Sequence: Synthetic oligonucleotide
cuagucaacgcgaccaccacg

SEQ ID NO: 345 - RNA, 21 nt, Artificial Sequence
  Description of Artificial Sequence: Synthetic oligonucleotide
uaguuuguuuguuuuuagaag

SEQ ID NO: 346 - RNA, 21 nt, Artificial Sequence
  Description of Artificial Sequence: Synthetic oligonucleotide
uuuguuuuuagaagaaagccc

SEQ ID NO: 347 - RNA, 21 nt, Artificial Sequence
  Description of Artificial Sequence: Synthetic oligonucleotide
uuuuuagaagaaagcccucag

SEQ ID NO: 348 - RNA, 21 nt, Artificial Sequence
  Description of Artificial Sequence: Synthetic oligonucleotide
uagaagaaagcccucagaauc

SEQ ID NO: 349 - RNA, 21 nt, Artificial Sequence
  Description of Artificial Sequence: Synthetic oligonucleotide
cacagaauggauucugagggc

SEQ ID NO: 350 - RNA, 21 nt, Artificial Sequence
  Description of Artificial Sequence: Synthetic oligonucleotide
cuccugaggucaccuuccaca

SEQ ID NO: 351 - RNA, 21 nt, Artificial Sequence
  Description of Artificial Sequence: Synthetic oligonucleotide
cugggggugagggagcacugg

SEQ ID NO: 352 - RNA, 21 nt, Artificial Sequence
  Description of Artificial Sequence: Synthetic oligonucleotide
ugccuggacacagcuuccugg

SEQ ID NO: 353 - RNA, 21 nt, Artificial Sequence
  Description of Artificial Sequence: Synthetic oligonucleotide
guccucuucccuaggaaugau

SEQ ID NO: 354 - RNA, 21 nt, Artificial Sequence
  Description of Artificial Sequence: Synthetic oligonucleotide
uguaacucaggacauugaagu

SEQ ID NO: 355 - RNA, 21 nt, Artificial Sequence
  Description of Artificial Sequence: Synthetic oligonucleotide
aauguccugaguuacagaagc

SEQ ID NO: 356 - RNA, 21 nt, Artificial Sequence
  Description of Artificial Sequence: Synthetic oligonucleotide
uauugugccugucaucauucc

SEQ ID NO: 357 - RNA, 21 nt, Artificial Sequence
  Description of Artificial Sequence: Synthetic oligonucleotide
ucugcagaaauguuccccguu

SEQ ID NO: 358 - RNA, 21 nt, Artificial Sequence
  Description of Artificial Sequence: Synthetic oligonucleotide
cucugcagaaauguuccccgu

SEQ ID NO: 359 - RNA, 21 nt, Artificial Sequence
  Description of Artificial Sequence: Synthetic oligonucleotide
ugccgugguggaggagaggug

SEQ ID NO: 360 - RNA, 21 nt, Artificial Sequence
  Description of Artificial Sequence: Synthetic oligonucleotide
uggccauuuguaaugcugacu

SEQ ID NO: 361 - RNA, 21 nt, Artificial Sequence
  Description of Artificial Sequence: Synthetic oligonucleotide
cuuguaaguaguagcagcagc

SEQ ID NO: 362 - RNA, 21 nt, Artificial Sequence
  Description of Artificial Sequence: Synthetic oligonucleotide
caaggaugcuuaccaccaggg

SEQ ID NO: 363 - RNA, 21 nt, Artificial Sequence
  Description of Artificial Sequence: Synthetic oligonucleotide
uaaguaguagcagcagcagca

SEQ ID NO: 364 - RNA, 21 nt, Artificial Sequence
  Description of Artificial Sequence: Synthetic oligonucleotide
ccaccaggggacauggcccag

SEQ ID NO: 365 - RNA, 21 nt, Artificial Sequence
  Description of Artificial Sequence: Synthetic oligonucleotide
aauguggcaacguggugcuca

SEQ ID NO: 366 - RNA, 21 nt, Artificial Sequence
  Description of Artificial Sequence: Synthetic oligonucleotide
ucuucugcaagcuccauguuu

SEQ ID NO: 367 - RNA, 21 nt, Artificial Sequence
  Description of Artificial Sequence: Synthetic oligonucleotide
gccccagcagacgggcacgag

SEQ ID NO: 368 - RNA, 21 nt, Artificial Sequence
  Description of Artificial Sequence: Synthetic oligonucleotide
aucaguccugagcaccacguu

SEQ ID NO: 369 - RNA, 21 nt, Artificial Sequence
  Description of Artificial Sequence: Synthetic oligonucleotide
caucaguccugagcaccacgu

SEQ ID NO: 370 - RNA, 21 nt, Artificial Sequence
  Description of Artificial Sequence: Synthetic oligonucleotide
gccaguaucuggauguccaau

SEQ ID NO: 371 - RNA, 21 nt, Artificial Sequence
  Description of Artificial Sequence: Synthetic oligonucleotide
cggaaauccccauuuagccag

SEQ ID NO: 372 - RNA, 21 nt, Artificial Sequence
  Description of Artificial Sequence: Synthetic oligonucleotide
gcggaaauccccauuuagcca

SEQ ID NO: 373 - RNA, 21 nt, Artificial Sequence
  Description of Artificial Sequence: Synthetic oligonucleotide
cgcaaaggagaugugucccug

SEQ ID NO: 374 - RNA, 21 nt, Artificial Sequence
  Description of Artificial Sequence: Synthetic oligonucleotide
gauccggcagcaguagauccc

SEQ ID NO: 375 - RNA, 21 nt, Artificial Sequence
  Description of Artificial Sequence: Synthetic oligonucleotide
ucaucauucauuaugccuggg

SEQ ID NO: 376 - RNA, 21 nt, Artificial Sequence
  Description of Artificial Sequence: Synthetic oligonucleotide
cuucugcaagcuccauguuuu

SEQ ID NO: 377 - RNA, 21 nt, Artificial Sequence
  Description of Artificial Sequence: Synthetic oligonucleotide
agguuaaauuuuucaucauuc

SEQ ID NO: 378 - RNA, 21 nt, Artificial Sequence
  Description of Artificial Sequence: Synthetic oligonucleotide
augaccaacuucagguuaaau

SEQ ID NO: 379 - RNA, 21 nt, Artificial Sequence
  Description of Artificial Sequence: Synthetic oligonucleotide
accugaaguuggucaucaaac

SEQ ID NO: 380 - RNA, 21 nt, Artificial Sequence
  Description of Artificial Sequence: Synthetic oligonucleotide
uguuguuucugacauuagcca

SEQ ID NO: 381 - RNA, 21 nt, Artificial Sequence
  Description of Artificial Sequence: Synthetic oligonucleotide
ugacauuagccaaggucaccc

SEQ ID NO: 382 - RNA, 21 nt, Artificial Sequence
  Description of Artificial Sequence: Synthetic oligonucleotide
gaaaggcugcagugaagucuc

SEQ ID NO: 383 - RNA, 21 nt, Artificial Sequence
  Description of Artificial Sequence: Synthetic oligonucleotide
acugcagccuuuccaaggaug

SEQ ID NO: 384 - RNA, 21 nt, Artificial Sequence
  Description of Artificial Sequence: Synthetic oligonucleotide
ccaaggaugcuuaccaccagg

SEQ ID NO: 385 - RNA, 21 nt, Artificial Sequence
  Description of Artificial Sequence: Synthetic oligonucleotide
cacaucuucccuuugacugug

SEQ ID NO: 386 - RNA, 21 nt, Artificial Sequence
  Description of Artificial Sequence: Synthetic oligonucleotide
uauagcagagacacagacacu

SEQ ID NO: 387 - RNA, 21 nt, Artificial Sequence
  Description of Artificial Sequence: Synthetic oligonucleotide
uaucagggaggcuccccagug

SEQ ID NO: 388 - RNA, 21 nt, Artificial Sequence
  Description of Artificial Sequence: Synthetic oligonucleotide
cuguuagauuuauaucaggga

SEQ ID NO: 389 - RNA, 21 nt, Artificial Sequence
  Description of Artificial Sequence: Synthetic oligonucleotide
uguuuccauagcaaauaucca

SEQ ID NO: 390 - RNA, 21 nt, Artificial Sequence
  Description of Artificial Sequence: Synthetic oligonucleotide
cauagcaaauauccacauugg

SEQ ID NO: 391 - RNA, 21 nt, Artificial Sequence
  Description of Artificial Sequence: Synthetic oligonucleotide
cgggacucuggagcaaccauc

SEQ ID NO: 392 - RNA, 21 nt, Artificial Sequence
  Description of Artificial Sequence: Synthetic oligonucleotide
aaaauuaaagcgccgaagaua

SEQ ID NO: 393 - RNA, 21 nt, Artificial Sequence
  Description of Artificial Sequence: Synthetic oligonucleotide
cauuugaaaauuaaagcgccg

SEQ ID NO: 394 - RNA, 21 nt, Artificial Sequence
  Description of Artificial Sequence: Synthetic oligonucleotide
uguuucccccuuacuagggua

SEQ ID NO: 395 - RNA, 21 nt, Artificial Sequence
  Description of Artificial Sequence: Synthetic oligonucleotide
guuucccccuuacuaggguau

SEQ ID NO: 396 - RNA, 21 nt, Artificial Sequence
  Description of Artificial Sequence: Synthetic oligonucleotide
gacuguguccugcugcugcug

SEQ ID NO: 397 - RNA, 21 nt, Artificial Sequence
  Description of Artificial Sequence: Synthetic oligonucleotide
ccccuuacuaggguauucuca

SEQ ID NO: 398 - RNA, 21 nt, Artificial Sequence
  Description of Artificial Sequence: Synthetic oligonucleotide
cuaggguauucucauagcaaa

SEQ ID NO: 399 - RNA, 21 nt, Artificial Sequence
  Description of Artificial Sequence: Synthetic oligonucleotide
aauucuguaucuucucuuugc

SEQ ID NO: 400 - RNA, 21 nt, Artificial Sequence
  Description of Artificial Sequence: Synthetic oligonucleotide
auuuccacagccucaucucuu

SEQ ID NO: 401 - RNA, 21 nt, Artificial Sequence
  Description of Artificial Sequence: Synthetic oligonucleotide
uuuccacagccucaucucuuu

SEQ ID NO: 402 - RNA, 21 nt, Artificial Sequence
  Description of Artificial Sequence: Synthetic oligonucleotide
cacagccucaucucuuuggcc

SEQ ID NO: 403 - RNA, 21 nt, Artificial Sequence
  Description of Artificial Sequence: Synthetic oligonucleotide
gccaaccucccucccucagga

SEQ ID NO: 404 - RNA, 21 nt, Artificial Sequence
  Description of Artificial Sequence: Synthetic oligonucleotide
ccaauccugagggagggaggu

SEQ ID NO: 405 - RNA, 21 nt, Artificial Sequence
  Description of Artificial Sequence: Synthetic oligonucleotide
cuucugagcgaauucccucug

SEQ ID NO: 406 - RNA, 21 nt, Artificial Sequence
  Description of Artificial Sequence: Synthetic oligonucleotide
auauacguucucuucaauggu

SEQ ID NO: 407 - RNA, 21 nt, Artificial Sequence
  Description of Artificial Sequence: Synthetic oligonucleotide
ggguugucgcuuugcaaugcc

SEQ ID NO: 408 - RNA, 21 nt, Artificial Sequence
  Description of Artificial Sequence: Synthetic oligonucleotide
gguugucgcuuugcaaugcca

SEQ ID NO: 409 - RNA, 21 nt, Artificial Sequence
  Description of Artificial Sequence: Synthetic oligonucleotide
ucucucuaugcaggguccuca

SEQ ID NO: 410 - RNA, 21 nt, Artificial Sequence
  Description of Artificial Sequence: Synthetic oligonucleotide
uacaccccagccgccccaggg

SEQ ID NO: 411 - RNA, 21 nt, Artificial Sequence
  Description of Artificial Sequence: Synthetic oligonucleotide
ccccagcagacgggcacgagg

SEQ ID NO: 412 - DNA, 21 bp, Artificial Sequence
  Description of Artificial Sequence: Synthetic oligonucleotide
ttaggatggccttctccgacg

SEQ ID NO: 413 - DNA, 508 bp, Artificial Sequence
  Description of Artificial Sequence: Synthetic polynucleotide
cgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagct

SEQ ID NO: 414 - DNA, 81 bp, Artificial Sequence
  Description of Artificial Sequence: Synthetic oligonucleotide
gtacttatataagggggtgggggcgcgttcgtcctcagtcgcgatcgaacactcgagccgagcagacgtgcctacggaccg

SEQ ID NO: 415 - DNA, 385 bp, Artificial Sequence
  Description of Artificial Sequence: Synthetic polynucleotide
cgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtacttatataagggggtgggggcgcgttcgtcctcagtcgcgatcgaacactcgagccgagcagacgtgcctacggaccg

SEQ ID NO: 416 - DNA, 947 bp, Artificial Sequence
  Description of Artificial Sequence: Synthetic polynucleotide
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagaggtcgtttagtgaaccgtcagatcactagtagctttattgcggtagtttatcacagttaaattgctaacgcagtcagtgctcgactgatcacaggtaagtatcaaggttacaagacaggtttaaggaggccaatagaaactgggcttgtcgagacagagaagattcttgcgtttctgataggcacctattggtcttactgacatccactttgcctttctctccacaggg

SEQ ID NO: 417 - DNA, 195 bp, Artificial Sequence
  Description of Artificial Sequence: Synthetic polynucleotide
gaattcgggcggagttagggcggagccaatcagcgtgcgccgttccgaaagttgccttttatggctgggcggagaatgggcggtgaacgccgatgattatataaggacgcgccgggtgtggcacagctagttccgtcgcagccgggatttgggtcgcggttcttgtttgtggatccctgtgatcgtcacttgaca

SEQ ID NO: 418 - DNA, 1723 bp, Artificial Sequence
  Description of Artificial Sequence: Synthetic polynucleotide
atctcgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcggggagtcgctgcgacgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaatt

SEQ ID NO: 419 - DNA, 511 bp, Artificial Sequence
  Description of Artificial Sequence: Synthetic polynucleotide
ggggttggggttgcgccttttccaaggcagccctgggtttgcgcagggacgcggctgctctgggcgtggttccgggaaacgcagcggcgccgaccctgggtctcgcacattcttcacgtccgttcgcagcgtcacccggatcttcgccgctacccttgtgggccccccggcgacgcttcctgctccgcccctaagtcgggaaggttccttgcggttcgcggcgtgccggacgtgacaaacggaagccgcacgtctcactagtaccctcgcagacggacagcgccagggagcaatggcagcgcgccgaccgcgatgggctgtggccaatagcggctgctcagcagggcgcgccgagagcagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccag

SEQ ID NO: 420 - DNA, 1195 bp, Artificial Sequence
  Description of Artificial Sequence: Synthetic polynucleotide
gaattcaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggtctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgacatcatttt

SEQ ID NO: 421 - protein, 7 aa, Artificial Sequence
  Description of Artificial Sequence: Synthetic peptide
GHHHHHH

SEQ ID NO: 422 - protein, 9 aa, Artificial Sequence
  Description of Artificial Sequence: Synthetic peptide
GHHHHHHHH

SEQ ID NO: 423 - protein, 6 aa, Artificial Sequence
  Description of Artificial Sequence: Synthetic 6xHis tag
HHHHHH

SEQ ID NO: 424 - DNA, 21 bp, Artificial Sequence
  Description of Artificial Sequence: Synthetic oligonucleotide
acaacagccatcctgcaggca

SEQ ID NO: 425 - DNA, 21 bp, Artificial Sequence
  Description of Artificial Sequence: Synthetic oligonucleotide
ggatccagcaaggcaacgctc

SEQ ID NO: 426 - DNA, 21 bp, Artificial Sequence
  Description of Artificial Sequence: Synthetic oligonucleotide
ggatgcagcaggccaagggtc

SEQ ID NO: 427 - DNA, 21 bp, Artificial Sequence
  Description of Artificial Sequence: Synthetic oligonucleotide
ggatccagcatgccaaggctt

SEQ ID NO: 428 - DNA, 21 bp, Artificial Sequence
  Description of Artificial Sequence: Synthetic oligonucleotide
cagaagacagtgaggaagagg

SEQ ID NO: 429 - DNA, 21 bp, Artificial Sequence
  Description of Artificial Sequence: Synthetic oligonucleotide
cagaagacaggtgtgatgaga

SEQ ID NO: 430 - DNA, 21 bp, Artificial Sequence
  Description of Artificial Sequence: Synthetic oligonucleotide
cagaagaaagggagggagaga

SEQ ID NO: 431 - DNA, 21 bp, Artificial Sequence
  Description of Artificial Sequence: Synthetic oligonucleotide
cagaagagagggaagaagaaa

SEQ ID NO: 432 - DNA, 21 bp, Artificial Sequence
  Description of Artificial Sequence: Synthetic oligonucleotide
tagaacacagggataaagaga

SEQ ID NO: 433 - DNA, 21 bp, Artificial Sequence
  Description of Artificial Sequence: Synthetic oligonucleotide
cagaagatacagatgaagaga

SEQ ID NO: 434 - DNA, 21 bp, Artificial Sequence
  Description of Artificial Sequence: Synthetic oligonucleotide
caaaagacatggatggagaga

SEQ ID NO: 435 - DNA, 21 bp, Artificial Sequence
  Description of Artificial Sequence: Synthetic oligonucleotide
cagaacacaggaataaagaga

SEQ ID NO: 436 - DNA, 21 bp, Artificial Sequence
  Description of Artificial Sequence: Synthetic oligonucleotide
agagggccaaggctcagctga

SEQ ID NO: 437 - DNA, 21 bp, Artificial Sequence
  Description of Artificial Sequence: Synthetic oligonucleotide
aggggaacaaggctcagctca

SEQ ID NO: 438 - DNA, 21 bp, Artificial Sequence
  Description of Artificial Sequence: Synthetic oligonucleotide
agcggtccaagcctcagctga

SEQ ID NO: 439 - DNA, 21 bp, Artificial Sequence
  Description of Artificial Sequence: Synthetic oligonucleotide
agaggcccaaggctcagctca

SEQ ID NO: 440 - DNA, 21 bp, Artificial Sequence
  Description of Artificial Sequence: Synthetic oligonucleotide
aggccttacgtgaggtgtggg

SEQ ID NO: 441 - DNA, 21 bp, Artificial Sequence
  Description of Artificial Sequence: Synthetic oligonucleotide
aggccttgcctgatgccaggg

SEQ ID NO: 442 - DNA, 21 bp, Artificial Sequence
  Description of Artificial Sequence: Synthetic oligonucleotide
ttcctccctctagtggcttaa

SEQ ID NO: 443 - DNA, 21 bp, Artificial Sequence
  Description of Artificial Sequence: Synthetic oligonucleotide
gtccaccctctattgactgag

SEQ ID NO: 444 - DNA, 21 bp, Artificial Sequence
  Description of Artificial Sequence: Synthetic oligonucleotide
gtgctccctccagtggctcag

SEQ ID NO: 445 - DNA, 21 bp, Artificial Sequence
  Description of Artificial Sequence: Synthetic oligonucleotide
gttctgcctctagtggatgag

SEQ ID NO: 446 - DNA, 21 bp, Artificial Sequence
  Description of Artificial Sequence: Synthetic oligonucleotide
ctagtaagtggtagcaccagc

SEQ ID NO: 447 - DNA, 21 bp, Artificial Sequence
  Description of Artificial Sequence: Synthetic oligonucleotide
gttttaaatagtagcagcagc

SEQ ID NO: 448 - DNA, 21 bp, Artificial Sequence
  Description of Artificial Sequence: Synthetic oligonucleotide
cttataagtagtaggagcagt

SEQ ID NO: 449 - DNA, 21 bp, Artificial Sequence
  Description of Artificial Sequence: Synthetic oligonucleotide
cttaaaagcagtagcagcagc

SEQ ID NO: 450 - DNA, 21 bp, Artificial Sequence
  Description of Artificial Sequence: Synthetic oligonucleotide
ctcataagtagtagcagcagc

SEQ ID NO: 451 - DNA, 21 bp, Artificial Sequence
  Description of Artificial Sequence: Synthetic oligonucleotide
cttttaagtagcaacagcagc

SEQ ID NO: 452 - DNA, 21 bp, Artificial Sequence
  Description of Artificial Sequence: Synthetic oligonucleotide
cttttaaagagtagcagcagc

SEQ ID NO: 453 - DNA, 21 bp, Artificial Sequence
  Description of Artificial Sequence: Synthetic oligonucleotide
aaagggtgcttagcaccaggg

SEQ ID NO: 454 - DNA, 21 bp, Artificial Sequence
  Description of Artificial Sequence: Synthetic oligonucleotide
aaagcatgcttaccaccaggc

SEQ ID NO: 455 - DNA, 21 bp, Artificial Sequence
  Description of Artificial Sequence: Synthetic oligonucleotide
gcacgaagcactccgctgtgc

SEQ ID NO: 456 - DNA, 21 bp, Artificial Sequence
  Description of Artificial Sequence: Synthetic oligonucleotide
gcaatgagctctcagatgtgt

SEQ ID NO: 457 - DNA, 21 bp, Artificial Sequence
  Description of Artificial Sequence: Synthetic oligonucleotide
gaaggaagctctccagtgtgt

SEQ ID NO: 458 - DNA, 21 bp, Artificial Sequence
  Description of Artificial Sequence: Synthetic oligonucleotide
ccacgaagctctctgaaatgt

SEQ ID NO: 459 - DNA, 21 bp, Artificial Sequence
  Description of Artificial Sequence: Synthetic oligonucleotide
tgttcagagacaatagaagcc

SEQ ID NO: 460 - DNA, 21 bp, Artificial Sequence
  Description of Artificial Sequence: Synthetic oligonucleotide
tctgcagggacattgagagct

SEQ ID NO: 461 - DNA, 21 bp, Artificial Sequence
  Description of Artificial Sequence: Synthetic oligonucleotide
tctgcaaggtcaacaggaacc

SEQ ID NO: 462 - DNA, 21 bp, Artificial Sequence
  Description of Artificial Sequence: Synthetic oligonucleotide
tctgcagggacaaaatcaggc

SEQ ID NO: 463 - DNA, 21 bp, Artificial Sequence
  Description of Artificial Sequence: Synthetic oligonucleotide
tcatcagagacaatagaagcc

SEQ ID NO: 464 - DNA, 21 bp, Artificial Sequence
  Description of Artificial Sequence: Synthetic oligonucleotide
actgcagagactataggatcc

SEQ ID NO: 465 - DNA, 21 bp, Artificial Sequence
  Description of Artificial Sequence: Synthetic oligonucleotide
tctgcagggaatattgcagcc

SEQ ID NO: 466 - DNA, 21 bp, Artificial Sequence
  Description of Artificial Sequence: Synthetic oligonucleotide
tctggaaggtcaaaaggagcc

SEQ ID NO: 467 - DNA, 21 bp, Artificial Sequence
  Description of Artificial Sequence: Synthetic oligonucleotide
tctgcaggaaccacaggaacc

SEQ ID NO: 468 - DNA, 21 bp, Artificial Sequence
  Description of Artificial Sequence: Synthetic oligonucleotide
tctgcaaggaaaaaaggaggc

SEQ ID NO: 469 - DNA, 21 bp, Artificial Sequence
  Description of Artificial Sequence: Synthetic oligonucleotide
tctgcaggggcaataggggaa

SEQ ID NO: 470 - DNA, 21 bp, Artificial Sequence
  Description of Artificial Sequence: Synthetic oligonucleotide
tctgaagggacagtgggatcc

SEQ ID NO: 471 - DNA, 21 bp, Artificial Sequence
  Description of Artificial Sequence: Synthetic oligonucleotide
ccagcagggacaataggagtt

SEQ ID NO: 472 - DNA, 21 bp, Artificial Sequence
  Description of Artificial Sequence: Synthetic oligonucleotide
tctccagggaccataggggct

SEQ ID NO: 473 - DNA, 21 bp, Artificial Sequence
  Description of Artificial Sequence: Synthetic oligonucleotide
tctgcagcgaagatcggagcc

SEQ ID NO: 474 - DNA, 21 bp, Artificial Sequence
  Description of Artificial Sequence: Synthetic oligonucleotide
tctgcagggagtagaggaacc

SEQ ID NO: 475 - DNA, 21 bp, Artificial Sequence
  Description of Artificial Sequence: Synthetic oligonucleotide
tctacaggggcaatcggagct

SEQ ID NO: 476 - DNA, 21 bp, Artificial Sequence
  Description of Artificial Sequence: Synthetic oligonucleotide
gctgcagggacaacctgagcc

SEQ ID NO: 477 - DNA, 21 bp, Artificial Sequence
  Description of Artificial Sequence: Synthetic oligonucleotide
actgcaggtataataggggcc

SEQ ID NO: 478 - DNA, 21 bp, Artificial Sequence
  Description of Artificial Sequence: Synthetic oligonucleotide
cctgcctggacattaggagcc

SEQ ID NO: 479 - DNA, 21 bp, Artificial Sequence
  Description of Artificial Sequence: Synthetic oligonucleotide
tctccagagccaataggagct

SEQ ID NO: 480 - DNA, 21 bp, Artificial Sequence
  Description of Artificial Sequence: Synthetic oligonucleotide
gggtgcatacatgtgtgcctg

SEQ ID NO: 481 - DNA, 21 bp, Artificial Sequence
  Description of Artificial Sequence: Synthetic oligonucleotide
ggtcacctggattccttgaga

SEQ ID NO: 482 - DNA, 21 bp, Artificial Sequence
  Description of Artificial Sequence: Synthetic oligonucleotide
ggtcccctggagccctgcgga

SEQ ID NO: 483 - DNA, 21 bp, Artificial Sequence
  Description of Artificial Sequence: Synthetic oligonucleotide
tgtcatctggacccctgggga

SEQ ID NO: 484 - DNA, 21 bp, Artificial Sequence
  Description of Artificial Sequence: Synthetic oligonucleotide
ggtcagctggatccatggtga

SEQ ID NO: 485 - DNA, 21 bp, Artificial Sequence
  Description of Artificial Sequence: Synthetic oligonucleotide
tatgacctgccttgaggggag

SEQ ID NO: 486 - DNA, 21 bp, Artificial Sequence
  Description of Artificial Sequence: Synthetic oligonucleotide
tatgacctgtttgctggggag

SEQ ID NO: 487 - DNA, 21 bp, Artificial Sequence
  Description of Artificial Sequence: Synthetic oligonucleotide
tatgaactgtataaaggggag

What is claimed is:

1. A composition comprising a nucleic acid-guided nuclease comprising a Type V CRISPR nuclease polypeptide, wherein the amino acid sequence of the Type V CRISPR nuclease has at least 98% sequence identity with SEO ID NO: 112.

2. The composition of claim 1, wherein the amino acid sequence of the Type V CRISPR nuclease has at least 99% sequence identity with SEQ ID NO: 112.

3. The composition of claim 1, wherein the amino acid sequence of the Type V CRISPR nuclease has 100% sequence identity with SEQ ID NO: 112.

4. The composition of claim 1 further comprising a guide nucleic acid (gNA), comprising a spacer sequence that targets a target nucleotide sequence within a polynucleotide, or a polynucleotide coding for the gNA, wherein the gNA, is compatible with the Type V CRISPR nuclease.

5. A method for modifying a target polynucleotide within a cell comprising:

(a) contacting the target polynucleotide with the composition of claim 4; and (b) allowing the nuclease to modify the target polynucleotide.

6. The composition of claim 4 wherein the gRNA is a dual gRNA.

7. The composition of claim 4, further comprising a donor template comprising a polynucleotide coding for a polypeptide to be expressed by a cell.

8. A method for modifying a target polynucleotide within a cell comprising:

(a) contacting the target polynucleotide with the composition of claim 7; and (b) allowing the nuclease to modify the target polynucleotide and allowing the polynucleotide coding for a polypeptide to be expressed by the cell to be inserted into the target polynucleotide at or near a portion of the target polynucleotide with which the spacer sequence is complementary.

9. The method of claim 8 wherein the donor template comprises homology arms.

10. The method of claim 8 wherein the polypeptide to be expressed by the cell comprises a chimeric antigen receptor (CAR) or a portion thereof.

11. The method of claim 10 wherein the cell is a T-cell or an induced pluripotent stem cell (iPSC).

12. The method of claim 8 wherein the donor template comprises a mutation in a PAM within 50 nucleotides of a target nucleotide sequence within the target polynucleotide.

13. The method of claim 8 wherein the spacer sequence is complementary to a portion of the target polynucleotide that is within a safe harbor locus.

* * * * *